United States Patent 11,001,841 (CCCTC-BINDING FACTOR (CTCF) RNA INTERACTOME) - sequence listing, part 59

SEQ ID NO: 138618 - DNA, 1022 bp, Homo sapiens
gtagagtagtcagaaatgccaggagacatcttgtctttaaagcacttacatactctgcatacatgagcaaataagacaaaaactagatatggttgcaggtcacaggacagagaaaggcatctgtggggccctagaaattacctactccatcacagaaaactgaagtcagctttaaagcaagaaaatggcctgtcttatctttgtattttcccagggcttagcatagtgcctggcacatgttagttattcggtaaatgtcttttggattcccaagtaagggctggtattagttttctagcgctgccataactaagtgagacaaactgggtggtttaaagcaacagaaattattttgtcacagttctagaggcccgaagccccaaatcaaggtgctggcagggccaggttctctctgaagctcctaggggaggattcttccttggttcttctagctacaagtaaccccagatattccttggcttgtggcaggatcactccaatgtctgcctccatctttacatggctgtcttccttctgtgtgtctctgtgtctctgcatgggattctcctctctgtgtctctctctgtttcttctcctcttcttaaaaggacattagtcatatttggattagggcttaccccagtgacctcatcttaacttgattacatctgcaaagaccctattttcaaaataggtcatgttcacaggtactgggattaggatttcaacacatctttttagtgacacaatttaacccacagggtccaaatgaacccaggctcctaacagcattttttggttattaagtttagggaacaatctttttccagacctagctttgggcttgatctctattatagtcaagctctcactttttctgtctaactttctttgtacaatctttgtttgaatggtcatgttttcaatatcttaatttacttggacaaatggcataccctccccattgtttaaggtttgtttactttctttgtgcaagtgttctttgttcaaattctttcggt

SEQ ID NO: 138619 - DNA, 1648 bp, Homo sapiens
tattacacttctaaaaaatgaatgttcaaatatctcttttttttctccaggaaagactttgtttgcctcatcatattttggaagaacgaggacttgtgaaagttggtgtcacagttcaggcgctccttgaattaccaacaaccaaggcatctcagctttctgtggcttaatataacattttaaaattctaagtgtatagtttcatttatttgaagtgatttcaaatatttcaaattcatgaataagaatattccgtcaaaaatagtttgccttaggtcacgccttaggattttaaaaaaattacattgaaacatcaaacttaaacattgaattgcccgaacttctttgggggaaaactggattaacttaataagagtatttgataaactcaaattctctttttactaagtcagttgataatcttgattatttttcagaaagcagactgatactaaatttaaaatgtagtttcaatttaataatcacattaggtttaatttttttacatcatagcatattagtaaacatctggataaaggtaattttttttagcaatttagagcaattctatatttgagttatttaatacacttctaattctagtttatacacaatttcttcaatctttggtcttagttttctagaaaaaaggagtagaaaaaacaattctggctttatattaaattcttttagtattataggttggtgccaaaatattttcagttgtactgtagattgtttacatgtgaagtgcctgtgtaattgatgactcttacatagtcttaagcatttttgcaattttttaaatgtattaatagagtcaatggaactttaaaatattttagtagattttgtaaagtcagtaatatgtgaggatttaaatgagcctcacattgtgacatttgtggttttttagttagtccattgcagtttcccttaaattggttatttcatgttgtcaaaaataccaatgttaatatgattaatttatgctatttaattttgtgaaacttaatcatcttttaaaatgtattatttgaagagtattttatttctgtattgaaaatgttacacaaagcagtaaagtttttgagaactagtgaagtactaattatcaaggacattttgataaaactgccaaagtttgggtttatatcttccctttgagcagcattctatcagtgctgcctttagctatactcagagagcagcagttgaggaataggtttttactcaaaatctggccatttgtgaatcctgtaaaccttgtgatcttcaattactttgatgttaaattaaacacagactcttctataaatattttcatgagatactgtgttacacaaagtccttgttttaacttaggtatgggtaaatttacattggtggtattgcaggaatttttcaaaaacattactgtaatgaataactgagtttcctatagaagaacctgaataattacttttgtagtaaccaagcaagcatcatatcttaagtatgtgatcatttgcacttgttacctcttaatatggatgcaacttattaaaaatgttggcctgggtatttcaaagggtatatataaaaggtaaaaaactagtgtgccaaatggtataggaacaactgtactttttttgatcagttggcatga

SEQ ID NO: 138620 - DNA, 1019 bp, Homo sapiens
aaagcagtaggtttcttaataatgaatgacatcttagaatggtgagattatagaccaggtgtaagataatgagggcctggaaaagggtggtagttgtgagaattccaaagaagtaagtctgagagagattaaaaaaagaatcgacttgatgacatattggatatagtgaattaagaaaaaggaaaattctaagacaaccctcagattgcacacctgaatgaatgggaaatagcttggcttaagaaagaaatgttacttgatctgtataaagtacttataacaatgccttgcacatggaaagcattatttttgttagttattagtagtaggactatttacacctgttatatacttaaatttgttatcaggtaatgtaataaagctaccaaaatatgaaagaaccttgtacataatttactagtagagaatttatatgttcaagggaaaataaattatgtgttttaaatatttttcagtataaatcaatgaggaagagttcaagtggcaatgaaaatgatgaggtgagaaaagataatattaataattatttgaaatgtttacttatcatatgaagttggctcagtgagagtaaaatgtaatccatttttcagtttctttgttattgatttaatgcatggttttttttcaacaataaaaacatatgagcatcatcatacaattattaatttaatcatttaatttccatatgtcctttagaatggaattactaataattcagttttagaattttatcatcattcgtcttagacctgtcatatgtgagtgtgtgttgtctttcacatcttttatctttctaaatcagcctggtcgtcaattgagattttttttaggaactttgtttaggaactccttccacaaattctgcatgctattttaaaatttaaaattcgacttctacagtttgtgcattaccataaacctttctactgcacagtgtaaactatgcagcagcctatcattgttgaaaagatatattctcattaccataaatacttaag

SEQ ID NO: 138621 - DNA, 1032 bp, Homo sapiens
agttttttttagtctttgttaattattttaatataataaatatcctgtctgtcctttgacaatatatctttagatatttcacttattttagcttctgggaattccttagaatagacctatgcatagggcctacatagaataaacccattttgatatttcctgtagagcaacaggttttagaaacttaaatatatttctgtcaactttaagttttatgttgttaggccaaagtgtagacatgggtaaattctttacaatgtttttaaaaagataacatctaaggttcataatatatatttaaggatttattctaaatattttaacgtattaaggcatcttcaattttttagtgtctcagcagatgaagttaattcaccattatcacccctcacctggcaggtaagaagaaattaaattacaattatatctatcattttgttctcttttatttagttaaaataaattgtctcattatagcccttagaaaatcagaaggatcaaatagatgaacaaccgtggccagaatctcaccctataatctggcagagtgaagaaaggaggcggagcaaacagattagaaaagaatatttcaaggtactctatattaagtttttaaatttactttgtaattattagtttttattttgtcagttttgttttgagttaataaggtagactgtaactctctagttaaatgtagtaaatgtgttattttgatttctcacatatatggggtaatacaatctaattatatccataaggtttcagtaattgagaataattgagtagataaatataaattatgatttaccaaatactttgcaagatagacgaatgtttgctgcactgctagttgtagcaatatgtagtatgttttaaaagaattgtccaggaaaagtctttcattggatttgtttcaataaatatttgacacatatttacaattagcatttaactgttcctatgtaaataagtgttgtttatatagttctgaaaatgcttgagggcagatttttccatttttttcttctt

SEQ ID NO: 138622 - DNA, 1148 bp, Homo sapiens
gacagtaattcattacttttgactttgagattaatacttagaattatgtaacattatgtagaaatagttctctcttataatggttcatcattttctttctttggttttctttgaatggttttatttagttattaaaagtttaagaaacttgtgtttttttaaagaattggactggagcgctgattttgcatttagaattaaaatttttcatttggcaaaataactatgtattacataaacatacctcatatcatttgctgtgctgggaaaaataaatcagtcacgatggtacctctgtatctctttatcttctatctcagccaaaagttagatatgcaaagggcaataatagcatgggtagaagatatccaaactttgagaaagggtttataaacgaagatgcatggaaaagttgccgagcttcattttgttataaaatagtacacttatgggcatctgatctaaataatatttaaatattattttctagcaaagatcttcaaggaccagatgcagtttattttagagattttttttatatcatgtgatgtaatattcttaatagatttgggaattaatgtgttgatttacttctaggattcttaatcattcaacttctgtgatgagaaacaagccaaaacaaactgtggaatgtgaaaagaggtataaaaatatcttagtttttacatttaatattttataatgagtattgatcctttgacagtgatgtttttgtatataggctttaattaaataagtgatacagatttaatataactagataatttaaataggaaatgttttagaacatgagttaaatttacttttgatgtaagcaaaataaaaaatgctgatcttttttgctcatagatgcatttttgtcttgatagaatcatttatttgttcattcagtgaacatttattatattgctattcctgccaggaataatgtgtttctttatcattgattgtgtttattctctatgatactgtttatgttttcatttcttttcaattgggtggtactaaattcttctatgtgaatacatgatataaatccacatatatgaattcctgagaactagaagaccttgaaagtttctatttattctttttgatggtttgaatttagattagactcaactcct

SEQ ID NO: 138623 - DNA, 1080 bp, Homo sapiens
tgttaaatgttcttaccaaaataaaataaaattgacaaaagggagcatgttttttagaccaagaaaaatcaaggaaggaactgagaataaaatgatactattagaatattcttaatattaacttgataataaaaaaggaaattctgttgaaaaacaaaaaagttgatatgtattattaattattgagccagttttacaaatttccatgagtcttactcatttatgttagtgttgaaaaggtggctactgctctttttcttatactgattttctttgggggcgtaataagtagatgtttagctggcttcttaaattttgtttagttactattctaaagaaaggattaaaatatatgtgtgattttgcagtaaatagcttcatttaactggttcccattgcatgtttgttcctgctaacttacgctgtagtattttctgttgtgtctttccttttagtaattattttatttgcttttaggtgtgtcttgagagtttttctttattgtggaaagatgtgcttctaattactatgtgatacagctaaataacaaaaagcaattatgaaaagttataattaaagtataattaaggatcatggaaagcaaaactaggtttaggaagtttataattttgttttagaattatagaaattatggacattacctgttttattatgatttttccctgatcatgtgaacatttcaatttgaggagcatcatgttaacctctagcttgttataactaattaggtggatctctcagtccttgaaatctatgtattcttttgtttctgctttctttacaaatgactaccctgtctctccaaaaacatcttctcccatcttttggtttggttgatttatgtgaaatatgaatacagacagaggcctttaagttgtaggagcatcattcagtgataaactcttccagaggaccagagcagcaggacatgaatcaaggtatctagagtttgtggaagccttcaagtattatggggccaggttgacatagctgaattgtatagtcttttacttaaaataagtactagtaactggattagggaagtatgttaataatcta

SEQ ID NO: 138624 - DNA, 1031 bp, Homo sapiens
tcagccttcattctcaagtctcagaatcaaatagagagcagacatcaagaaatgacagtcacataataggaagtaagactgattctcagaaaggtaattcatatggtacctgctatttttgtttcatgtacatagcccacattaaaaatgggctttgaaaaattatattgtctttagcaaactcttacattgagaaaatacacatttttctaaggacagcagtgtcaagcatacagtttactatgtacattttctaataaatattaatctgtacctagaccaggaggtatatgattttgttgaccccaacacagaagatgtagcagttcctgaacagggaaatgcacatattggatcatttgtatcattctttaaggtaaataaaactttgaacaaatattaataacatgttctcttgatcttataaaagtggactatacaatttaaaatgtaactttcttttatataagggaaaagaaaaatgttctgaaaaatctcggaaaaatgaagaattaggagatgaaaaaaggtaagcacatatgaaaatgaaatgttatttataagcccttgagccattcattagatattcctacttgaaagagtacttgaaaaaaatataattttttgttcacttacctcttatgtttagatagttaatttataaatacttcacatctgtctgtattcctcaagtaaacacaaaattatagtaagcgtttgagtgtaggatgtgcactatttttacccctgaagtgtaatgatgacttctattattattattgaggaggactataccgtcatatacattgcttcatttgagctatttaacaaccataacaatagatggtattgacatcactttaccaattaagacactgaaaccaggagttttaaatggctggaactcagatgtattgtctcttgttctactatactttccatttggtcatgctgattatgacttttaagggtacttatgtccatattttattaaaataattgtgctttggatcttttttgaaccattcatc

SEQ ID NO: 138625 - DNA, 1045 bp, Homo sapiens
aacatgcaggtttgttacataggtatacatgtgccaattgagactgcataaaatgaccaaacttacaaattattggtattcctgagggatatgagagattaaaaggcttagaaagcctatttaacaaaataagaaacgaaacttttccaagtatagcaagatttagacatccagacacaggagactcagtgattcccaggaaaacacaatgcaaaaaggagtttgccacagcatattataatcagactgtctaaagtaaaaagaattctaaaatcagcaagacagcattccaccacagccaccattgcagagcagcagcaatggttctgtgctacactatggtcgtgggcctcaacaagggccacaagttgaccaagaatttgagcaagcccagacacagtcgtagccttgggcgcccgaccaaacacaccaagtgtgtgcggggcatgatccaagaggtatgtggcttcaccccatacgagcggtgcaccatggagttactgaaggtctccaaggacaaacaagccctcaagttcatcaagaaaagggtggggacacacatccacaccaagaggaagcgggaggagctgagcaatgtcctggccatcacgaggaaagttgctgctatgaaagactgagctccctgtcctgtcctctccctgaaataaagaacagcttcacagaaaaaataaaataaaataaaatcagcaagagaaaagcaccctgtcacctacataaggaaactccattagactaacatgagacttctcaccagaaaccttaaaagccagaagagaagggaatgacatattaaaaatgctgaaataaaaaaaaccaagactgccagccaagaactcaatatccagcaataagcttcataaataagaagaaatgaagtctttcagagacaagcaaatgctgaggaattcatcgccactaaactggccctacaagaaatgctcaaagaagtcctaaacgtggaagtaaaagcgatattcatcatcataaaaacacacaaaagtataaaactcactggtaaagtaat

SEQ ID NO: 138626 - DNA, 1066 bp, Homo sapiens
aaagtgaatttaattgttacccaaacaaatcctgaaaccttgcatagttgactctgtcaccagtgctacaaataagtggatatgtttcagcgtacttgctgctgctccctctgcttctttatacctgtttatgtacatgagcagtaggtctgtgaaacagatttaggaattcttacatcagattctgccgtgtcctggataatcacgtgttttcctgtaaaccaggagtcaactctagtatttcctacatgtgctggttcaccttttcaactgtagggcatggtgcattgtatcaggttgtaaaatggagccagataaacacagcatttgattttgtgaggtgaaggtcctctcagtgcatttagtggaatgagctcatgattgtgattttgtggccttattcaaatatctgccttgcttcatttaataaatgtcttcctgaaaaatcgaatgtgaagcacatttttgacagttgactcatattttaattgctatagattgaatctgaattactgaaccttgtactgatttattcagtgataagttctacagcatacttatcccttaatttctttcatttaaaataaaatgttatctttaattgaagggtacattcatcattaagataataccatttatacagctctttatacatttttaagtactttcatatatattatcctattgtatcctaataataaccctgtgagcttggcagagtacatagtaattgctcgttgtggttgagagacaggttaagtgatttgtccaaagttaaatggtgagtctggcagagtgtgtgggtcagagcctaggtttttcaactccagtgctatcctaatgttatttccagtgtaacacattctctctttataaaaaagcagttattaaacaccatgccaataaataggttatttattctgaaaattcaatgcttatttaacttcgtaggttatatactttttgtttgtggtatggtgtgttttgttttgtgtgtatttgcatagctatcatgcctctcttatggttttagaatagattcattaagcaagcatttattgaactc

SEQ ID NO: 138627 - DNA, 1070 bp, Homo sapiens
aaaggcatacgtgcctgaaagaatggcatatcctttttcagagtacagcagcaggattgccatggtttttctgtgtggtttaatcatcctacgatattcttggcttctttcttgtcacgtatgcctttaaagactgagatttttcattttcctggtgttgagaaggtagtggtggttaaattagtatttgctgcagtggtaaattaaatcatcaatcacttacatgtctgcttactagaagaaagctaatccttgttttgagttatcttagagtcttaatttttatagtagaaagccaacaattttaagggtatttttgagaaaaaattatctccattctttatggagttgtggattaaaggtttatcactttgggtgagaaattggctattgtaatgttcttcatatactctctggtagtctttgttgtggctggcattttttgttagggacacactctcttataaaccaatgctggattattttagatatgtcttgatttgatgaaaggtttttttttactttttataatctttaaatttgttatttatttctgttttcatctgctttgctgaaataaatctggacaaaattattttaatagatgtcgtcattttgaaacaatatagtaagtaaattcacccataatgaggagtagtaaaataccacttattttcaaaacaagacaatttcagatgtattcagtttttagatcttaaatcaaggtatttgtgttggaacaaagtggggagaggaggaaaacctaaaattgaagctttccacccagtgattcttttagcaatgatcctaagaactatgaatgtgtaatcgaccactgattttatattttgtaaagcatgttggagtatttactccttcactcagaacagatttcctaaataatatgttcacatattcatgactgttagcaagatattatgcaacttggtgtgttcttcaaaggcttcaagtaaaacagtttcagactgcatcattatagtgatttttttcttttcttcttcttcctcttttttttttttttcttattgttctttctaacctataaagga

SEQ ID NO: 138628 - DNA, 1080 bp, Homo sapiens
gtggttctttttggtgacactgagagggtacaagaagaaagtccatttgccattatcccatattctgttttaggcattatttctacttggattttcatgaaatgtactgacagtgttcttagcacatatgataaattcatgagtttgctgttgtgtttgatctagcataatctatgtggaatgtataagctgaactgtttcttttttgatgtttggtacagattatgaaagtagctggtataaaataaaatttgaaaatgaatatctctcaatacatgacaacaatggggtatctgtttttagaatcatgttgtctttggtcatatggcaatttttcttttggtgaagagtgatccagaaggcaaaatttttgatctgtgaaaataatacaactcatttagaagaagtcagctgggtcatgttttgagtctgtattattttagacagtgatataccatataatgtatattcagtgtgttggaggtttcaaagctttttggatacattacaatgttggaagatttttatataccagtggtcatgactagctgattttagttatgagagcgctttggttaaagttatggaaacagtctaatcgtgaaatgtcagtcttagaagatctgatcatacttgggccaatttattttagttacggaggtgagacaatttcagaagattcacgataaatttaataataccaaattttgccttagtcttgacacttggaagataaatattagtgagtataaactgttttagggatgaagaagtattgttagtatacaaaaatgaaaatactaattattttagcatgggtcttttagtcctttgcagtctggacagatagattatcttaagtaaatcattgaacttgccctcagaggaattagattctagatagtgctctgccattgactcataatttgaccttcggaaagtcatttaaaattattatattaataactaattgagtacatacatgtgccagacaccattcatgcttttgtttataaaaagagaggattgctcaagctttttggtttgctgggttttattttttcaaatattcataatctg

SEQ ID NO: 138629 - DNA, 1033 bp, Homo sapiens
attgtcacagaattcaaattgagcaggaatacgtaggatttcaaatctaacagttgtttcatttggtgggatagcatcaaagccatgtactgtgaccactgtatatggttttcttcaagagcagcaataaatttctgccatgtaccatgggaaagagctgtacttttagggagaaaggaaataagccctgagaaaaagccccattttcctagttcctttcacagttcacctggcacacaacgggtcttgatatttatatttgaaagagtgaaacatggatggccataaatgctccttgctgataacgattgaattgggaaaatctaatcaggaaatcagtgatttatgaattacattgcataaaatacataatgatgggagcctgtaagaagactaaacaaatggcttccttagtttatttttcctttaggttttagttgttttcagtgaatattatgagtgaatgttatcgatagtgttttcattgtgagaactgctaaactgtagagtcaaagaagaaattgggacatattaatattttgacttttatgccagctttattgagacataatatcatactttttttttttttgagacagagtttcgctcttgttgcccaggctggagtgcaatggcacgatctcggctcaccgtaacctccgcctcccagattcaagcgattctcctgcctcagcctccctagtagctgggattacaggcatgtgccaccacacctggctaattttgtatttttagtagagacagggtttctctatgttggtcaggctggtctcagactcccgacctcaggtaatccgcccacctcggcttcccaaagtactgggattataggcgtgagccaccgcgcccggccccataccatctatttttatagattttagtatattcacagataacatgcaaccttcaccagtcaattttcaaacattttcatcacctcagaaagaaaccccatacactttagctatcaccttccacagcactctacccctgcaaccctaagcaaccactg

SEQ ID NO: 138630 - DNA, 1035 bp, Homo sapiens
ggttgtttctacactatggctatcataaataatgggacatgcaaacattaagtgtctatccatgagtcccctaatgagttagaggtggtgctgacaagataacatttcacttattaccactctgctcttaatataaatccttgctttgattaagcactaccgatttttccatctaagtttttttgttattttttgttccttgagacggagtctggctctgctgcccaggctggagtgcagtggcaccatctcggctcactgcaagctccgcctcccgggttcacgccattctcctgcctcagcctcccaagtagctgggactacaggcgcccgccaccacacctggctaattttttgtatttttagtagagacggggtttcaccgtgttagccaggatggtctcaatctcctgacctcgtgatccacccgcctcggcctcccaaagtactgggattacaggcgtgagccaccgcgcctggcctctatctaagtttagctattttttttcttgtttcctgatgcttattggcttatcatcgacttgttctcaataacgttttccttagtagtatttatactggaataatagaaagcctgtaaatgctgtataatcatcttttctaaaacttattgtataataaacatttagcacagttttgtttaatcacattttttgaacactaaggagcaaaggcaagcagtattaaggagtacaaaagtacatgataaatgctttgaaatgcaatgggttcaatcaaccaaaagcattattgagcacagctaatatatttacttttaaatgtactattcaagtgtgaaatatatccatatagaacaaaattcaaaactcacaaagggccataatgataagtaaattagcctctaacacttaatatttttaagaagacattagtgttttacgtttaggtattttgacagtaagtttgagggagtctttatcttttgaccttttggggtgaatatgagaatgaaggaatataaaaagatgattaaaagaatcaccaggccggaaa

SEQ ID NO: 138631 - DNA, 1539 bp, Homo sapiens
gtctgcctcatcaaaagaattctgctaattgctttagccaatttctgaggtaataagctgggagagggaagaggttggttactcatgcataggtgactttttgctaacagtgtgatttttaggaagtgaagaccacaaaagctttttgacttgtggcagaattcattatgatgagactttagctgtaccaggtaacagattgccaaataaaacaccaaacaagcaagattggtcagttacaatccagtctgtagtagtctgatccagcatagtgttatgtttatggattcaattccctcctcgaagtcatacaattgaggcatctcagtagaaataaaacaaaataaacaaattttgtagggaagctcctatacatttgaatggtaagggcatataactattaatactttatgagaccatggtattttgcagccaatcttaaggataaatctacattgtgttcaggattctgtgttgggccagacttaacaatgaccattatgtgtagaaaatagcaaccattgttgctgaattaaactctctctggagatttaaacatttttttaaaaaattaagctaataggccaagcgtggtagctcacgcctgaatcccaacactttaggaggccgacgcgggcggatcacttgaggacaggagtttgagatcagcctgggcaacgtggcgaaagcccgtctctactaaaaacacaaaaagattagccaggcatggtggtatgcatctggtcccaggtactcgggaggccgaggtgataggatcacctgagcctgggggaggttcaggctgctgtaagctgtgattgcaccacggcactcagcctgagtgacagagggagactctgtctttaaaaaaaagaaaagaaaagaaaaagctaataaaaccttgatgacaacatagccaaagaaattaatcagagaagagtggtgattagaaacagaaagcatagtggaatagatgaattacacctggcaaaggaactctaaactatattatgtaaagctcaggacagtctacttgtctgaaaaagaaataccaaaagtatacacatgcaaaaatttggatttttcagctggactttttgtgaaaggttccctcccaccccaaattcaaaagaagtataaagcaggccattcatggcaaactcccaatgaaatggaattaatttgtattgtgttttgaaagtgtatatatgtgcttgcaggaattacatggaagaattatactgacatagagtggctctcaaagtgaataatggaatcttaaggatgttttattaaacagcgagtcaactatttttctccgtgaatgtgactccacaatgatagtggaagtcagaaaatatttcacatgcaaatatatctgaaattcttcatggatgtatttaacgctttgaagtgatggcaacatctggtagcaagtagaagccagcgtcttaaaagctatggcttcatgttactacttcatctgaattagtcatttaaaggggattttatatgtcttcctaaaaactgacgaggtta

SEQ ID NO: 138632 - DNA, 1055 bp, Homo sapiens
attattgtctatatttgtggtgggggtgggatttcaaatgcttttgatcccagttacatggtttttcaaaattctgtaaaatggaggttgaggtggctgtcatgacagaacatgtcacgattagattgatattatactcttcctacgtgagttaaatcaaacagttgtcttagtgtttataatttacaaaataataaacatcactggtgattaaattttgatggcgttattggtacttggcagcaatagtgatttctggtgctcacatacattaggattttccatcacatggttgtcatataagtttaatttccccatatttctggcaaagggaagtatagctagttatacagtcaatcctcactctgagttgagtcacctctcggactggttgtacttaatatgcgcatatgaagtaaaaagtgaagcatgaaacaaaacaaaccagttttttcaattaacaagtgctgtatttgctaacatataagcaaggtatataacactgcaagaggcattttcagtgacttgccgatagctttctgcttcgtgtatatagtgatttgagttgtaggtcacaatattttatggcatttttattttgaattgaagtgaagcatggtaactagtctgatcttgcctagcctctctctctctctctccctccctctctctctctctctctctctctcacacacacacacacacacacaccccacacacacatatccctgaaagttgcccttggcttcactcaaacatatgttaattttcataagaaaggaaactggtggaaatacttcttaggtatgaaaattaattaatttcattagcagcagatttattttcccataaattattcagattttgggggtagatgtaaaagtttacttaggcatggaagacattagaccttttaaaagcaaagtgggctatttcaatctaagaagttagttaatgtaccttagctttctgaagctaggggaaggagaggtgtctttttgttgtgtctttgggtttgaaatagtattcttcatcctaggaaaaagggcttttag

SEQ ID NO: 138633 - DNA, 1014 bp, Homo sapiens
aaaaggtgggacctccttttgcatggaatgtttataagatccgctcttcaggagattatcaggagattagcagtgtaaagattgcactggaggaagacagaacagcaggcagatctgataaaaaaaaaaaaaaacttttgtggggttgggggagggggaagggatagcattaggagatatacctaatgtagatgacgagttaatgggtgcagcacaccaacacgacacatgtatacatatgtaacaaccctgcacgttgtgcacatgtaccctagaacttaaagtataataaaaaaaatatataaaaagataaaaaaaaaacttgtggagtaggccagacatgaggtgataaacagatatgacggaagaatctcagatattgcaaggcaagaatccagagggatgggtggttgactgatcctccctttgttttttatggtcaaactgcagtctggagacagaggaaagtgggaaagttgaaaacgagacctgatttggcagaagaaagagttagaaaaaaacagggaaaataatgtggcagtaagttagattggagacacttagactttcctaacttgaatcgtcctcactgactttccttctcccttggccacttctaaattggaccctgatctgctgctgcgagtgtgtctgtcactaacacaaggcacaatacccttaccagtgatgtctctctgagaatgcccttactggggatgtctatctgagaaaatcctacttgcactcaaagacagagttcaagcctcacctcggaaaaaacttttctgacgcctaccatttagtatatatgactgtgatggcatgattgcactaatgttgtatctttgtttttccatctgtttcccccactagacagtaagctcttccagaaagaaggggatttggatcctaattgtctcttatctggagcacccaacacagtgcctggtacatactaagccttaagttaatgcttgattaatataaataaataagtgggtgagtgtggtagac

SEQ ID NO: 138634 - DNA, 1046 bp, Homo sapiens
tccacacgctatgattttgctgaatttctaaggagataatcaaggctattattgttaatagatggggaaaatcatctaatgatttccatattttgtcgcaattgaactgagacaaagtagtctttcctattctctgccaacccacccccacaaaaaggaaaaactgtccttcacaggataataagttatagagcttgtttttaaaataaagtgtccctgaattagaaaaaaaattctataacacctttgacggttgcctgagggttctgtaagtaacaacaacttaaaactacaaagattttttaaagaaaatcgaaagactcggctgggtccttaaatgagtttctaaaagatggagtgtacacacaagcttttattatgctgaaaaatatatataaattttatatgctacaatttaatggcaaaaacctttaataataaattccactgtaatgaaaatcttcacaacaaaggccctctgaatgtatggttgataatgacaaaaatcccagtacatcaaaaggctatgtatatagttccttgggtttcaatcaatgaaatatttactgagaacctaacatgtgtgcaacactatgctagatactgagtggagactacaaaagaataatattcacaataggcagaaattctggattccagaattctttacagcatatatagtaataagagcctgagtatgttaggaacatatgcctggcaggggctttggcaaactgtacgcctatcttaaactctacttaaacaatagctccacaatgaccttttcttgcagtcaaacttctcattgatcccttacttaatacaatttaactccttcctctatgaagataattggtcaatcctctttatgtcattaagcttttaagggacaatgaagttcttttactcgtcaaatgtattccaagtctcatcaggtaaacaatatctgaattaactttaatttttaaggaatattgcacgtaattatttccaagatgctgcacatgaggacaagacctgtattcagcatttacttgaggagatga

SEQ ID NO: 138635 - DNA, 1824 bp, Homo sapiens
caaactgctggaaattttgagtcagaaaaggactgataaacatttttgattgcctggtctcaccctctaaacttgtccagccttctgctgtacttgacctccatctttggaaatccactagtacagtgaattctaaagcagcaacctccagtctacccttagctggaactcattaaactgcctcttatatttgctgcagtgagctacctcaaaaggtataagctgtgagaagcaaaccccatgtttagctaagcatctggagatgtttagcagctgccttttctaaggatttaatgcctaatgaaagcttgatttcactgcttagatcttgggatggaatatagtttaaattcttctgcccaagtcttttgaccgagtcttttaagtcagtattttgtgagctttcatgggcattcaggattgtgtatgtgtgtaaacccattattgttagataaatagattccttttgtcatttctttagtgcagaaaatttgtagaatatgttggtcaaaccaaattgaacttttaaatccagcttttccaaaaggatatgcatctgcacttgctaggctttcttctttaagtcctaatgagcactgtcctgagtgggctaatagagaggtcgcatgtgtattccagatgagggcacacaatatgtgacctcttcataaagaaagacaccagatttagacagattcaaggatgtttaaagcaacacacacacacacacacgcatacacacacaacccgagcgtcaaagaaaatcctagtctttcttactgtcaaatttatgagacaaagtagcaccccaaaagacgcttttgaagtgatagattgcagcacgtaccacctggacatgggcagtgtaaaacagcagctaaaatcaaaaccacttggattctggcttagctttctccagacaagtacttaaaatagcttaaataacaggatgcaaggggagggaaaacatttccttttaaggatatgcattcttggtgtgattcaaacttctgcaggaacatggctgtgtaataagtttatttactttaaggtttacttaggggagggcggcgggggagttaaatagtatttaaaataatacttggtaaaagagaataatgagatttcctttaaaacaaaatgcagatgtgaacctacacgtgtcatcagagagagagagagagagagagagagagagagagagagagagaaaggaaacagtccttttaacagttgattcttttcttatgaattcagtcagtggccaatatgaaaaatgggcctgtctggtgcagcactgggagctgcgtagtgatttttttttaagtatcataattttcttcttttaaaaaaaaacgctttgtcaatttactcaaatttagccctttactttctgccagaattgtgttcagtgataaggtagagtttcctttatccagcttctccttaatgtccagccatactgaccatattttctaaaccaaaaggttgagaagtgctggcattgaaactgcactgcacaatataggcagtatggtaatttatgtctgctttatcagctggttggaaactatgatgctgaaacagaagagtcttcaaaacacagagcttttcccactccataccaatgtatagttaatgagaaaatggcaagtgagccaaaaaggtgttgcagagtattggcagcatgaatgagaaaataaaggactgccatcattcctggtggttgtgattttagtttccagttgttaaaacgacttccaatctaggtatgttattttgggtcagtttattattaagttctcatgtttatgtcaaaactca

SEQ ID NO: 138636 - DNA, 1048 bp, Homo sapiens
acctctcttgaacattaattagaagacagttcactgatgtgattaaaagatgccaggaagtagccaccctaaaacataattaacataaaataaccacatttggaaatttcattttgaagtaagggcagtagtaagaaatgcttttagaaagggacaggaaaattttaaaggaaattggaggaataagaatttgtcattacatgacaaacttccttattaggctgcaaatctcccgataaagattcttttaaatctttgtatctcccaccccaatatgtagcacaatcttttgtgtataataagcaatggaaaaaaattatttttgtagaatcactgattctcaggaattgaccaaagaaagaatgctctaatcctagatgagcattttagaaacaaaactaaacaacaatgacagaaatacagaaatagcactcaaagactgaatggcaattcatcgagaaaccaaaacttgacagaaatatcccttaaataacattcaatctcattccctttgttctaatcctgtccctacccagcagccttcagatctgtaatttggttttctaagtgaacacacccatcaaggagggcccaagtggaccaccagtgatagctctctggtcaggatctcttttgttccaaatgtagaaacctgctttggctttactgagaaaggagatgtgcacttgtttaggtatgagtcaccctccagagcaaactgagtacctaccctgtgggaagacacccactgggctacataccaaagatacagaaatgaatcaaacggaacccctgggtcttacttgaaactgtggctacaaaatccttgtaaaaattttgagtcacttcgaatacatatccttaggctttcctggatgacaagaatgtgcgtcgtcttctaaaagttttacctattctgccattttcccatagtttagcccccagtgttagtccaaattacactacctcccatgatcaaaggcattttagtgttagttagagtcaattttatcaagcctttcttagagctcttaaatcatatattttg

SEQ ID NO: 138637 - DNA, 1598 bp, Homo sapiens
ctgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataataattagtctgttcttcatgcttttgtctcttaggaagtatgccaatgtttgtcaggatttttttctttttgtttttctgatgtattctgtaaaatggtgtttgttaaatttgagttttgggagctgaattagaggtactgaattaaggacagtacaaatgaagtaaaaaggttttctccaatttaccaaaatttctttatccagttcctgcttttttctttcttttccacctccctcagtcttttcaatgttctatgatatacatatcctgaaacagtggggatctgaacagtcacagaggagaaatggttcatagtagatcttctcaatctcatccatatatgacatttttggctggataactctgttggggtggggagaaggggctaccctgtgcattgtaggaggtttagcagtattaccggcctctacccactagatgtca

SEQ ID NO: 138638 - DNA, 1008 bp, Homo sapiens
cttctttactccagaactctgttctttaaagaccaagattacattctcaattagaaaactgcaatttggttccaccacatcctgactactaccgtatagttttctctattctttcatttcccccttccctattcctttattgtacataaagtaactggtatatgtacacaagcatattgcattttttttaactaaacagccaatgatatgttttgattgacatcaagtggagatgggatggggaaaaatactgattctgtgaaaataccccctttctccattagtggcatgctcattcagctcttatctttatattccagtaagttattttgctctcactgttttaacaaaaacaacaacaacaacaacataaaaatccttgcatacctttttcaattggagaattttaatgattttcatttatcattgtaaaaccaaggacaattttataactttttcgtacatagctgctacatgtagggcaatctgtctttaagtagggataaattactctaaaacaaaaaagaatcctagatacttttcccttcaagtcaagcgtcttgtttaaataaactgcttgtttaaaatgaaaaaaaaaaagttaaatataggtttaccatgtgatccagcaattccactcctaagtatatacccgagagctaaaaacagatattcaaacaaaagttatgcatgaatgtttgtggcagcattattcataaaacccaaaaggagaaacaacccaaatgcccatgaactggtgaatgtttaaacaaatgtgctatatgcataccatggattattttagccataacatggaatgaagcacagatacataatacaatgcggatttaaccctaaaaatattataataaagaaccagacacaaaagaatgcagattgcatgatctcatttatatgaaatggccagaataggcaaatctaaacagacacaaagtagattagtggatgccaggggctggggaagggggaataaggaatgactactaa

SEQ ID NO: 138639 - DNA, 1017 bp, Homo sapiens
ttctccttttgggttttatgaataatgctgccacaaacattcatgcataacttttgtttgaatatctgtttttagctctcgggtatatacttaggagtggaattgctggatcacatggtaaacctatatttaactttttttttttcattttaaacaagcagtttatttaaacaagacgcttgacttgaagggaaaagtatctaggattcttttttgttttagagtaatttatccctacttaaagacagattgccctacatgtagcagctatgtacgaaaaagttataaaattgtccttggttttacaatgataaatgaaaatcattaaaattctccaattgaaaaaggtatgcaaggatttttatgttgttgttgttgttgtttttgttaaaacagtgagagcaaaataacttactggaatataaagataagagctgaatgagcatgccactaatggagaaagggggtattttcacagaatcagtatttttccccatcccatctccacttgatgtcaatcaaaacatatcattggctgtttagttaaaaaaaatgcaatatgcttgtgtacatataccagttactttatgtacaataaaggaatagggaagggggaaatgaaagaatagagaaaactatacggtagtagtcaggatgtggtggaaccaaattgcagttttctaattgagaatgtaatcttggtctttaaagaacagagttctggagtaaagaagcaggttcccttttcagtagacacctcccgtctgctgttggaacacatcaattgtatcttcatcctccatttccaactgtgcaggtgtgtctgtttcattgattggttgcccgtcgaatcggaatctgatctgcctcactgacaatccctgtcgttcacaataggctttcattagtttactaagtggtgtatgcctcttaatcttaaactgcaccacagaaccatcctgccccgccaccttcaaattaatatgatcgttgttctcagtcttgactccttccttg

SEQ ID NO: 138640 - DNA, 2365 bp, Homo sapiens
gaacagtattgataaggtatatgtcataatatgtgactaaaagttatctgtgacagagctcctttaattacttttgcatttctataattatttacttcaaaactattgttttcattctttaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtcattttggtctgagacatcccattattgtctgatttgacttcctttgattaaatatctatatttttggcatggcaaaatgtgatcagaatttacagctctgagcagcttggatgagtgaatatgcctttttattcaaggaaaaaaagaatttgacaaaatctaaccttattcatcaaaactcattgctggttgtgtttggggaattagattatggaagatgctaactggcttttcatcaccacagaagaactgccagccatatctaaaccagaagagcagttacaattccgagtttagtctccctgatcttcaagaggatccatcttgcctgatgagaagggattgtgtaaaattaccttagagatttgtcgacctgggatcccaaaggaaaaatgtttttgtgaaagattatttgagaattatattagcatcgtattgtgatcttctctactttatctgcagatgatcagattaaatctgagccaaaaatttagggctatgataatacaactagtgagattccaaatttctttaccattaggtaattagcagtgcagatgtcactgcatctatcttgagttaaataattaaggaaacaattttctcaataggaaaagcttggtatgaatttgaaaatccctcttgagcattattgttctta

SEQ ID NO: 138641 - DNA, 1387 bp, Homo sapiens
cagcttctctgccttttaaaaagtgattacattttccatctttcttggtgacattgttctgttcttgaggttataacagactgattgaaagatacttaagtgagttgaggtcacttctccaaaatacattatgttaaaagatgataaatacattactgacaggaagtattcttaataaagatcttcatattatgccgccaaccatcttcaggttaagagtagtactggctgcaatgatggtgggtatatacgaactattagctttaaagtataaatgtagagaaattattatcagtgtccattttgtagtctgtatatgaattaaagcagtgggcttcagaacataaaccaagaagtgtgtatattttcattctcaatgtaaaagtttgcttcttatgtattaacgtttgtttctatcaacatggggacccagaattgaggagtttttcatttcttttgatttttttcatcctttcttcctatgtttttagagcaaagaaaatggagaaatgtcaaattataaatatgtaagcagattacagaataaatcttagtgatttctgcaatgacagaaatttgttagattcttacactatctagtctaatgtaacatgtactaatggtttatattattaatatagtctcaataattactgtaagagctcccccaaagtcttacacatatctatcatagctataatagatatgtttcaagtgtttggatattattactgttccacttaagagaaaaataattaattgctaaatttgaagttaaaaataattttcttttctttttttttttaacagccacagtagaatgttacaatccaagaacaaatgaatggacctatgttgccaaaatgagtgagccccactatggccatgctggaactgtgtatggaggagtgatgtatatttcaggtaaacaagtatcatgtgaacacaatataatatataagcttttaactatatggttatctttccatatagtggtagtaataataataataattcaggcgtcaggagtttgagaccaggcgggccaacatggtgaaatcctgtctctattaaaaatacaaaaattaactgggtgtggtggtgcacgtctgtaatcccagctacttgggaggctgaggcaggagaatctcttgaacccagaagacggaggttgcagtgagccgagattgcgccactgtactccagcctgtgtgaaagagcgagactccatctcaaaaaaaaaaaaaatccagaaaaacggagaatcaaaatataatttatgttgattttagaaactatttttgtgtgtatttgcatatgaatgtcttgggcattctgtaaatttataagagtactagtaaaccaatcctgttgtaaggtataactt

SEQ ID NO: 138642 - DNA, 2625 bp, Homo sapiens
ttaaagtctaattaaaataatctatgaaaataacaatgtgtgtgtgttaaccttagagatttcagtgatattatatcctaactgggctgtcattttatgcggaggagtaatgtttttagctttgtttcagtttttaaagaaatgtcaacaggaggattattttattttctcttaaccatctgccaaatctgttaactatacaggtgtgaggttaacaatacattgataaagtttgtgtgatattgaggacacataacctgacaaaattttaaaaacaaccaaacatttaagtcttttgcctgtgatctgtgtctgtttgtatacatacacactggcattttttattgtaggcttgtttttgtggtttgttctttgtattatatttgctaatattatttttcctatttttcctttgatgagtcagttattagagcattgaaaagaggttctactgaggaaaggcctctctgtcacttctcttctttgtcagcttttcactttatggtatattttgctctatggtggggagatggttctgggctcatgttgacgccagagagaaacagaatgtgctgaaagtaagagtggctaaggaaagctgtgttgcccagatggaagcagtcatcacagataccaaaatctcatttacatgagagatttgttgtagatatacccctctgcccttaagaaagacatttccttgcttatatttccagataaataatgttgaaaattaatttgccctagggataattatcttattaaattattttcattatgagtgataactttgaaggaaccaaaatgaatgatagtaatgagtgatgcctatttacgtgaaagggaaatctagggtttgggtattagagcttttctgttcatggatctgctagctgtgtggtatttttaagaataatgactaagaagtggattgagatgaatcataatagaacaaccttctattttcccaagtttccatctggcaggaattttatcagtattttgggggtgggggtgggatacatttttgaggagagaagagtaactggtttggccatattccagttataacattgtttcttagagtagcttctaacttactgactttgatcattttcttttagtcagccttctagtggattaagtaaaggtggtttgcaaattatctgtttgtagatcattgatacatttagataagaatcctatttgtatctatttgaacattaaaagcataatttactcttattctagaacaggtatttgtgctatcaagatgtgattgccatgaaagtagtcatgttttaattttttttaattggcttaataggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcgtaagtgcatttatattaagcatagagacaaatttcttcactcagaaattcttatcaaatcataaaataagcagtcctgtaaaatcagataaaaatgtagttagggttttattttaaaactatttttctgagaaaatattgaagaccatctttatgccttatctgggcatatatcgttggcaagggaacaaattgtacgttacaaatacatcagtatattgtagcatatttcacctgtgcagtatatatggtcttcatcttgaaggttcatctaaagagtatacttagctcatttaaattataataaggtcttggatagaagtttggcatgttttctcattttctgcttttaaaaggccatatgatattttactgaacaggttacaatccttcattacagaaaactttcattgtttcttcttttacaaaatatgttacctattagtggccacaaagataattttctttatagattaaatgtacaaagttcaacattatccaa

SEQ ID NO: 138643 - DNA, 2167 bp, Homo sapiens
agtcttattctgtggacatggtttcattctctgcattgattgtactagatatcaggctgtcattttaataaactagatagcaccaagtagaatttggcgcattgaatggctaaggagttccccaaatttttgccagatttcttagtctttgcatttcccttgagagtacaaaagcagatactggctggtccgagtgcagtggtgtttacaactaattgatcacaaccagttacagatttctttgttccttcttcactttgactgcttcactcggctagccagaaaaaaaaaaaaaaaagcagatacccatttttttctaaatgggaatttctttgtataaaacaccaatcttttaaaaaaagtcctagatttcagatgaaatcttccattaaaatagcaaattatgttaatgacagtgttttgggtacatcagttataatttgaatagtacagcagcagtgaggaccagtatgttattgagaataccacttgcaatattatgatgttggaagtgcctttaggatgactatgactgttgtttggttataaaagaataatttataataatttatatcaaagaaatgtaaatgagcagttgattattttaagaacaattttataggttcccacaggtgcttgaagagttttatccttttttgttgttcttttttttttttttcttttttttgatggagtcttgctctgtcaccaggctggagtgcagtggtgcggtcttggctcacagcaacctccgcctcccgggttcaagtgattctcctgcctcagcctcccaggtagctgggaatacaggcgtgtgccaccacgtccggctaatttttgtatttttagtagagatgggtttcaccatgtgggccaagatggtctcgatctcctgacctcatgatccacccaccaaggcctctcaaagtgctgggattacaggcgtgagccaccgcccccggccttgttgttctttttaaatgccaatgtagttatttggattaacttctgttataactctgtttttaagtgaaccttctttggaattgtggccaggttttcagatgaaataaaagatgaactcagatgaaatttctacttagaaatttttaaaataagctttaaacttcatattttatattttcaatgtgtattctattatatatgtaaattgcattataagtccaattatccatttatggatatccaattatccatttatccttttatgtatccagtggataaacaaacacatgtatccatttaaaaatactgtctaggcttaatgtttggagatttctagctgagtcacttttaagaatcatgatggagaagtggattaaaatgaaccataatagaatattatgtatttctctgggccattgtttactataattccatcagttttggtctatttatattgttaattattactgtagactttgcttctttaatttctatattctatgattaatttttaagctttgattacatatacttgctaagaattaatttcctattacatatttttcttgtctgtgtctcattttgaaattaataaggttttagtaatttgctacattaattcaacaggtatcctatttttaattgcatctatcatcgtatctttactttttatatttttgatacttgtagtatttagcctttgttgtatactcacagtatagtagctgttgtatatgagctatagaaaatacttagtcttgggtaccccataaatatatataccaactatgtgcctacaaaaattaaaaactgaaagaaataaaaaaagaaaatacttagttcttctgtcaagaagataacagttcggaaggttatggaatacctttctctggtgattttaaagaaaaaagtaggcagctatttgtattggttagatggtctgtcaaagtcttttctagtcttgtgtgtctgtatatatgaacgtattgatatacagaaggtattttccaaatgcctgtaaataaaatttaagtttctttctcatgttattctagcaatcgttttctcactggataaatttgaagagggaaaaggtgaaggaattaaataccttgatcccatttctgaattatacagtttggcttttaatctttaatcttgctctgttttacatgctataaatttagatttcagtttggtg

SEQ ID NO: 138644 - DNA, 1845 bp, Homo sapiens
aatacaattagtagaaagaactatcgtgtacttaatacagttgctctctacttttctttctcaacctcccccaaaacaaaacaaaaccaagatgcttcagtcaagcactataaaaggactattaaattatcgcgaaaaggaatgttaagacagtctaatactctcattctgcagatgggaaagtagaagtgcacattgtaattatttttcaaaataaggtaaaagctgataattgtgtaaataagcaaaagtatatactttttccttaatcgtttttaacctaaattagtcttaattttgtgttattcctacagtgaaagaaaacatgcattgtcacatatcaggaaagttgtgcagttattttttcttctcccgaatattctgttggctttatgttccacatatgttgcaccacattaatattcaaacaattttagcacacgaagatttgtaacctcattttaccttgattagtgactcaactcatgttcttgttgtagggctttgaccagcttcgacttgaaggattgctttgtgatgtgaccctgatgccaggtgacacagatgatgctttccctgtgcatagagtcatgatggcatctgctagtgattacttcaaggctatgttcacaggtagtttgccttttaaaactctgaaaccacattaaaacaatatgaaaaatccgtgtttaaatcttttttatttctaacatgaaatttggttcttttggaaacagcttcaaaagaagtacacaacagtatgtatggttttcggtggtgctgttttaacatggaaaattgatgcacttttttcatactgtccatctttatctcacagcttttctttttcaagcttatatctagtgggccatcagagactctgtgtcctcctagtacaatctctactctatgtcaaaaaataggaagtgagaacattttggaagcacttgcatcatatatgacctccattagtatagagattatcttttttaagtactttcttttaacagtaaaatgtgcagcagactgactctaatatgactgcttatataagataagactttcctttgattttattgcatctaattagcagcagaagtgagtttgaccataattatccaccttcatttaattgaatgtctttttatttaaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtaagatattttgaaatctgatttttcctgtggtagactctgatgtagcctgtttaggactcatgaaatctgctgtgcaggaatgtgaaacttgccattagacagatgtgtcttgttgtatgtggtctgtaagcaaggtgagattgaaacaggtgcatttttatgaaatagaatcatttaataaaagcctctgtgttggccgggcatcgtggctcacgcctgtaatcccagcactttgggaggccgaggcgggcagatcgtctaaggttgggagttcaagaccagcctgaccaacatggagaaagcccgtctctactaaaaatacaaaaattagctgtgcatggtggtgcatgcctgtaattccagctacttgggaggctgaggcaggagaatcgcttgaacctgggaggtggaggttgtggcgaactgagatcacgccattgcactccagcctgggcaacaagagtgagactccatctcaggaagaaaaaaaaa

SEQ ID NO: 138645 - DNA, 1064 bp, Homo sapiens
gaggtggaatttgggcaggtgtggtgactcacacctgtaatcccagcattttgggaggctgagacaggtggcggttggggggcatccttgaggccagcctgggtaacatgatgaaaccccttctctacaaaacaacaacaacaaaggaggtctaatttaagctagtctttgaaggaggaaggatattccaggtgaaaaaaaatttttatcaccaatgtgatcgtttggagaacaacctgataagacgggtcagagtatatagggaactaataaaaaataaggttgggatcagatcaaagaagtctctgcaaaccagaagttgtgctatattgcagtgatggaaagtctttacgtttttaaagtctaagcagtgttatataataatgagcacagagtttaaaattaatataaacatttatgtccagcctatatatttgttttaacttaagtgcatctgttcctttttctgtcctttgaataaaatgaagagcagcctcataaaaacatggctggtattgtttttatctaatacattacatttacataacactggagtaaggccatttcttaactttctttagttccttaatctttgttcatagaacatattttccattataattttaactactcttttcaggatgtgtttcgttttttctctacttaaaatgacaatgatcaaaactagatataatatgctagtaagtttgttctaatgtagaatttagttgaattatttgtttatcaaattccttttaaatacctgacagtatcaatgtagctttttttcacaatagcattatatttcacttgaaagctattgacatccaagtaatttttatacaaattattcatagcttgtctggtttccatgttataatcctgtaatatcaagtcatattctattctgttttaatatgatcattttaaaatttatcaaactcattagatgtttcagactttctttgtttcctggtattagatatgtacctctctctatttaatagaggttgaagttttgatacattgggtaagtttaatacagtgaagagaaaaaacatgtt

SEQ ID NO: 138646 - DNA, 1758 bp, Homo sapiens
cctgggccaaccactttaataagtggtttctgacccttctttagtctgtgtataaaattattggcaagtacctgctatataatgactattcaataaatggtagctatcatttttatcttttcaaaattaggtgttccaaattaattttaactatatgcagcataatttgatggcattgctatctaaatagtaacatatcaacagtaattactgtggcctttaaaaactctgtgactataattttgaaccaccttttaagttgatttctcagttatcatctgtatattctgtacttggaaaccattttacaaatatacatttcttctaagataaagagtggtacaagcgtataatatagtgaaacaatattcaccatattgcatggtcatatgattgcaatagtgactgattatttttctaaataatctcattgtaaattgtacaagttttaatttccccttctttcttatgtaaaaaaactttcagatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacaggtaatttaagctgtctctttggtagtgtttacgtagctttaaaaaacccaccatggattttgtgatgcaggatgtcagtagtggaggaggttgtgggtgtgtatgtgtgaataggaaatgtatggtaactattttttgctcagttttgctgtgaacccaaaatggctctaaaaaatgaagtttattaagtaaagaaacaaaagacaaaaactaaccaggagagaaatcttgatggaggaatgcacacattcctgaggttaaaaaatcctcagaatcaattttttgtttggtttgtataaaggacattttgccagtatgccactttcttacagaataccatatctgatttcattccatagcaatcaaagtaagtattacaaggtccctacactgaattttcctagttcctcattcacagcctgttttactatcatctttgtaatggttctaaagattatatttatttggtgtcccaactcgcattggtagtagtaactgtgggagaagaggttaggactgctggatgcaaaccctctgatacatgtaataagtaataactaaaataaaagcaggggacagaaacacagtagaaagccaaaagaacatgaaacacagcaatctggagctatttagcacggggattagaagcttaagtacttctgacctttgtggacattttctgacttctgtgggcattgctgaattagagagcaatatggtactggatgtccattaatgtcttctaaagatagttaaattatattggtcctcttactacccttaataagataaggaaaatttgcctttctaaatgcatatttaaaagaaatctccccagatggatttcatgcatatccctgatcaagaaccattatagtaaagctgtatatagaatataatataatgagggacaaggtttatacttgctgtgcatcctctgtgtttaaatgtaatttcaccggatttcattttccttatctccaaaatgtgactcttgactagcatacctctaaatttcctgctagtttcaatctttgaattcagtaaaatcccatttccccagtatttccgtttctaattggagctggggtctatctaaggttcattgtcctgtgggtcatcaatagata

SEQ ID NO: 138647 - DNA, 1104 bp, Homo sapiens
tagaaataaaataattatctcattcagaaaatagaatggattcttacataccttatctacctaccattcatccatccatgtatccctttatccatccatccatccatccatccgtctacctatctaccaatctacccatctgcttatcttgctttcacacaaatataagaaatgtggagaatgagaaataatatataaactaagctttctaaatagaaaacatttttggtcaagatgaattggacatgatgcagtttaactggtatataaattttaaaagatgaagggacactaaagtcttgaaatatggtaagcagagggagcaaatattattttgaagttctttaaggacaagattgagatattcagtggaaatgccttttgatttgggtaattaactttcatcctgttatagttatctaatggaatatcatttgtctagcccaattcccttatctacgtcatagtgttatatctgttattgtgatggttggcattagagttcagaatgtgttcttttaaatgttgatatcagtatgtgaaattctccccaaatttcatctgagttattttctaggatttactacctccctaccccataagtgttgggagaatagcatgaaagatttttagtgttggtattgtttttatggaaatagaatggtaaaagtaagtgatcttcagattgaattaattaaaccagaaaattacttgcctataacagaatgtatctctctgatatcctccttgtgcttataaattaagcattgaaatgctaagtgacttatagcctctactgtctgctatttttaattttttaggcttggtataaatgggaacaatgtaggctctggattcagatgtgggttcaaatcatagttactagactcatggtgaggccttaaactctccgagcttcagttccctgtctttattttattttatttttttattttattttattactattatactttaagttttagggtacatgtgcacaatgtgcaggttagttacatatgtatacatgtgccatgctggtgcactgcacccattaactcgtcatttagcattaggtgtatctcctaatgctatccttccccc

SEQ ID NO: 138648 - DNA, 1653 bp, Homo sapiens
ttagaaatcactcttttggtcataccatttaccttgaaagagaatgtgatattaatgcttgatcacttttcctccatctgtgtacatttgtatttgatgatttaacccagtcttaatttatatttccttttaaaaataccatttcttcaactgcattaaaattaatattaaagaccagctctacaaaatcttaactaggtttctctttattaaatgtgattatatcagagctcttctcttgtctgacagtgaaacatgttcttaattaatagtctgatctagctttagtttgggtggacctacaaaatatttgaaatacaattttgaaaagtatatggatgacactaaattgtgaatcattgtccaatagataaccccttagcatcaccaaattgaagtgattttctcattcgttacgatcactttcctacagagggtgcgtgcatgcagtcatttctgaatgattcacagctaaacaaagttcgtgaaactggaaacaaaggtttggttttaagtagactggagacttggttcattaatatacttttcatagaaatgttgctgaagcatatagatagatacaattagagtgttttttttaaatgatgtgcagtactatcacatcatcaagagttttgactttcttccatataattaaaattgcagattatgtttttgaatagtgaatattgtgtgattgctgatccagccctgcagatagcctgatctggaacaaataaccctttaaaataatagtaaggaaagttgatattatttatttatttttatttggtgcttatatgctaaatatgaactgatacccttatggattagagaaaaaagttggcaatcgttttgttattgtggtttctatgaattatacaacatgatatttgttagtaaagagtggtaagcatttattataattttatatcatttaattatttggaaagtaattgttttttattatcatctcttagcaagcaagtatcctgactgctctttgttttattatcatctctttgcaagcaagtatcctgactgctctttgttttcctatcatctagtgtggtgcctggcacatagcagatgctcaataaatgtcgattttataaatgaatttagagaatagtttttaggtctgtacctctgtgcagatcacttcacatgaaagtgttaagtttattcatctgatatatgcagtaattgaatatagtagttgtcccttatgcatgatttccaactccttggaatgagttacccatggttaaccatggcatgaaaataggtgagtacagtatgataagatattttgagaaagagagagagaaaaagagcacattcacataacttttattaaagtatattgttataattgttctatttattactagttattgttgatatcttactgtacctaatttataaatcaggtagttatgtatgtataggaataaaacgtagtgtatatggaatttggtatatccatagtttcaaacatccactgggggtcttggaatgtatccaccgaataatgggggctattgtgtatcatggtcttgttagagaataagttatgactgtatttcctatgaaaagaactaatcaaaaatccagattctgttcattgttgctgagaaataccatgatact

SEQ ID NO: 138649 - DNA, 1025 bp, Homo sapiens
tgtccctacaaaggacatgaactcatcattttttatggctgcatagtattccatggtgtatatgtaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaaatgaagcaatttatgtttaaagttcatagtgtctttttaaacaacaagaatggaatactattctttacattggacagggaataatttactgtttgtgtgctttatagcacacaagtttacatatattaccttccaagcagtaataatttgatctcaaactctaagattgaatcttagtttaaaataaaattatattgtgttttcaattatactaaaatatttttcccagcataacttactatgatgaggttatctgttgtttttacccatttcccccccacatttatgtcatgctaaggcaagaacatgcccagtttgttggagaggatttcttataatatagttcaatggagtaatgaagtaacttatcttcaataacaaaaaaataaaaacaagtttcagaactttagattaaattttaatctagcatgtataacagatattctaaacttcatgagacatattccaaatttttaaaatgtcctagtttagcatagttaaatgtaatacaatttattttcctctattatagaagtgctaagcacttaatttcattcctcccaaaaagccctgtaagtgtacatcctctcactattttacgaataaggacaca

SEQ ID NO: 138650 - DNA, 1049 bp, Homo sapiens
gggcctgagattatattattttttttaattataggattcacactgtcccctagtgaatttacagtttgcaaattgcctttttgaaggccttacaatcagattgcttgctcctcactgtctgtgtttattcttttagcttcttcagatcttttagtctgaggaagcctggcatgtgcaaatgaagttaacattttgttttaaagcctattgtgtattttttaaaaagacctcttgaaatcatttaatataacagaaaaatattgcacacaagacacttgcaagacaaagagctagtgttcctgtcactttcagatatttcaaagacattcactggtcaataatttatctagattcctttttttatacttagtgtatcttccaagtaatcgcttcccccattgcaaagaaaccactttctacagagggaagagaggcagaatttcatatctccataccatcatgggaagtacggagttactgagaatttcatacattctgcttgaaacttagaatatttagttgagacttaagtatggccaaacttggggagacggagcgatgagaaagaagtatgggataggcaagtatttgtgctaataacttgcagttgaagagttaagaattacaaacaacatacatgataaaattttagattgacatggctgccatgatgtattgctttatatcctcaagactttgagaaaggcggtataaacatgagattcttggggaatcagtacataaataagttactgagtaattcattttagaaaatgctcagttctggatattagccctttgtcagatgagtagattgcaaaaattttctcccattctgtaggtagcctgttcactctgatggtagtttcttttgctgtgcagaagctcttgagtttaattagatcccatttgtcaattttgtcttttgttgccattgcttttggtgtttcagacatgaagtctttgcccatgcctatgtcctgaatggtattgcctaggttttcttcaagggattttatggttttaggtctaacatttaagtcttcaat

SEQ ID NO: 138651 - DNA, 3418 bp, Homo sapiens
aggctagtttgtaaaaataaaccagctatatttgtttttcaaaaactgtttgtcaaaagcacaaattaatggaggtgacaagttaatggaggtgagaagttaatggagctctttcacataattcgagaaaataggatgcttcctgactttatgcatcttaactggcaagaaatgactaaagatttaccaaaagcaactttattataaaaacaaaacaaaacaaaacctcactaaaatcaggttacaattataatggttattaatgtttctaatattcctactatatttgattgtctaaaagatccaaattgcagcccttattgcccctgatttgtcgatttttagagatggtgaaataaatccccatgttttattaaattcatgccagccacaagctcagatacaactcaacacaacattttaaattaatcactttcttccttttaagtgcttacctctttgacctgatgatatgagtgaatcaatttagaagatagaacctacaaaatataatagatcttgcatgttgactgttggttgttggtagtacacataggtagaatggaaaaatatattcaaagagcttatggtaggctgaagtattttgacattgtaacagactattttgacattacaacactctatattattgaattggtcttaacttatttttctttttatgtatattaatacttaatagtaagtaaatatgcacagatagaaatttatgtgaaatgtagcaagactagcttggggagtttaaatcaggtttttaaatatgttgtttagtttttgaccattttagatcacagttcattgcctcacttggccaaaaataaaaacatcatgtttaacatgtttttctcatcagtacttctctatattcctcaacacatttacacacaaaatgatacttaagtatagcataattccacttcaaaaatgataaagactgaattagattactgggtcaagtaacattatatttgttctcacaattgtttggctggcaaacataggtttaaatggttacttgtgtcttttgggtctaaactctttgcactgaaatagaattgttcaattctgactcctcaataaatcgtgatatataggaaatttacctgtaaaataatgtataagtatttaaagtagtattttgaatatagaattcttcataggtgatataagatctttttgtacgtatgcttgtgtagcatcagtattggtttgtaatgttttatcattacttaccgtgctttgtcaaatatacattacgtggttttcattgaagacttgagtactttgtcaaagactgaaatttcaatatgaagtattttaggtagtagtaaaaatgtgttatagtgattgagcatgtgtgggaaaaatctaaacgctccatggtctctttctaaacccagtgtatgtgctgctttgctgtagctcttccattgatgctacagatagggcagtactgctgtgctagtgaaggctacaatagagaacattttacttactgcaaacatcgagcagcaagactattacttttttccttgtgggtttaaagtccatgtttgttttctttctgtttgtttagaacttgaatgacagttgaaatgtcccaacatttttaagttttctttatgatgaagactatagtatttgtggcaatattagtagaaatagcatcttatatagtataaagcacttaaaaaattttgctgtaatgtcatactagaaaagtgggatatcttaaatacgaaagattcaggaaaataatacttcagtctctagattgattgatgatcaaatagtctttattgggtagacatattctttcagctttagattttagcattgcagggtggtgtgccatctatgtggatttctgaagggattgtcttgatagaaatagagtgcttggtgacatgtgtttgctttgcactctgttcaacagtaggttgaagttcaaccttagcctgagggaggatctcctggccagtgtaaactgcattagtaaagactctgcccctgacaggtgcaaaccatataaattactctgtcatttagcctaaattaataaagctgaaagagcaatcacatctaagtgtttttatggtgtttaggtattcattgttttaaaacagcaaatggttccttcaggcaaatattatagggttaatgccttgttagatgctaaggacacactgaaatagaacaaaattagcactagtgatcctttcatcttttcttttccagcagcgagttttgacaataatagtgtggcaaggaggaaggcaattaggtaagaattaaccagtgaaatataacagtgaattctagcaagacagaccctgtgagttgttttccttagaatgttacctttctcaatctaaaagacaatgaatgttagtgaactagacttgttctcctttagtccctgcacttacattcagttagcttcctatttatgattttttgatatgtaaaaaatatttttatagtaaatgccaaaaaacacaacattctatagcaattgcctctgtaatgtcttcaataaaattcagtacctggcatttcctgagaaaatattgtgtatattgtataaatgctccttgtttgtaggtgattcacagcacagacataataaaaatatgaattttctaaatttgacatgtttctatcccctaagattgtcttttttttctaatttagtaaataaaagaaaactttgtggttacagaaatctttcttatctagcaaaatacttattaaattgataatcatttgtgattagagaaatctttcttttctagcaaaatacttattaaattgataatctcaaaatagaaaagaatgtttagttgctttgagaacataaacttttacttgctttgtgtctacttaattttgtttttattacttatgcacaatttaacaaaattatgtggaaaaataacacaactaacacctaagataaattttgtgttagtctgcaacttttgtggcatgttctttgggaatttgcattgtctgagcttgcagaaggactaggttgtcatttattaatggaaaatcatagagatagaagtgaccttaaaagtcatttagaaagtccaaaccccttttaacacaggaactcattccatgacacctctcgaagatggcattgcatgtccttcttgaacactgtcactgacaaagggctcactacctcaccaaggctgcaccctccattcatggacagcttttccttgcattgagcaaaatcagttccttgtatcttttctctcccgttcccaatgcagccttatagagctatatagaaaaaaaaaaattctattacatacacgcttaggcgtcttctcatgtgacatggttttcagacccttcactcttcctggttgtcctcacgtggatg

SEQ ID NO: 138652 - DNA, 2702 bp, Homo sapiens
ataatttattaaaggaaaagtaagaactgaatatatatacatctccaccatcagatataatgcttttagggttttaggtgttttagagtgctgaggatggggtgtagggaggcagccttactttcttttcatgctgaacaaatattaaaattattggggtaccacaaaaacaaatattaaatattaagtctgcaaggaatctagactgaaaaattgacctggaagattcatggtattagatagcttctttggagcccaatgaaattcgacaaaagtatgttgttttttttgaatcagttgattgtttatagaagaataataacttatagaaggatattcttatagaagaataataatctttacaataaaatgatcttcacttgtttgtggtggttccctttttgggaatttggaaaactctaccttaacttgcctgttttccactcatcaatgtttgagaagtcttcatagacagataaactcctggaaacacttcactaccatgttttttacacaggtttttggatcttcattctcagaaggtgaagtagaccaggcacggtggctcacgcctttaatcccagcactttgggaggccaagtcgggtggatcacctgaggtcaagagttcgagaccagcctgaccagtatggtgaaaccttgtctctactgaaaatacaaaaattagccaggcatggtggcaggtgcatgtaatcccagctactcaagaggctgaggcaggagaattgctgcaacctgaaaggcagaggttgcagtgagcctggattgtgccaccgcactccagcctaggtgacagagggagactccatctcaaaaaagcaaacaaacaaaaagattcataagctggaaaatgattgagtctcttttctaaaacatcacctccttactacataatatatagctgctttatgttttatatttttaaatgtttgcaaatgcttcgggttttgaaaatttgtttgaaactcactgtggaataagacatttcaaacttgatgtgttcatacatgtgtgtggctgtgtgtgtgtgtgtgtgtgtgtgtatgtatttctccttctttggatttcaaacaagttgcccctgctgattatacctgaggcctttttgctatataaccattaaggattattgcagaaagccttctaatgtaaaatattgactataatttatgtgtattaatggcaggttaaaaaaaacttttaaatatattttggccactagcgcattgataaatattcctttctctgactcatttgacaatttctgtgagtctgttttgtgtgcaagtactaaaaggagttggatatgtaatttaaccctttaaaatgcttgactgggtttttgggggctgtttcttttgtatgataggttgaataaaaattgtatgtaaggtaatgatggctgacataattttaatatttacaaagttcatatattacttgtcaatctttcaaaataagctttctctttccatatatgtatgtatgtgtatatgtacatactgcatgtacatatatgttttgtgcttcacaggaaaatagtagtttgtctttttgccttgatattggtctgtatcttaaaaggaaggcatttgtgattatgttagttgatttcatgctgtatttcttatatactaaatttggtattttggaatttttgaaaatagttccttactgtagaaacattcatgtgtgtttctaaaatacagatgaaaaagcctcttaggggactaaatctcaatctttaaaaactaggaataatttggaaagaatattcgaacgctaactatttaagttggaagcatgagtttattgtttggatacagacttgaaagtaaatatgagctttgttcctgcagtgattttttaaaaataggtagttgctttcatgtcaatcatgatctgcctttactaagcttgcattgatggaaatggataattctgtttttaggtagaagcagaagggtactatgattgtgaattgcctatatcagaagtaaaattcttcagcctgtaaataaacagttcagcataatactcatttaacctatattcactttttagaattgtgtagaaaatttgtgagtttgttttggtgctttaaacagaagcttaaaagtcactttcagggcatttacaacgctattttctggcagtattttgaaacaatatagatgagccctttatttgccattgctttcatgaaatacctcaagctgcctttgacagcagcttcaatttttgaacctccttgacaatcgctaatccctataggttaccggacccgctgttgagctttggagtggtccctgctggacacctgcttggccagcagtgttggtctttcctctaggcaatttgtgagctgtctgcgggggagggaggggaggagtggggggggtggtgaacaagaggggaaaggggagagaaggggagggcagtattgaattagattgttgatagcgtccctctgaggactgctattaagagcatgctactctgtacttcgctgctgcagaagagagagtgatatttgtgttactacagcatgttgtaaatgtgtgagattttgctcatctcagcttggaaataagaatagggaaaggagagcaacttgaatcagaagctactagaagaacctgcagagttctgaagcagtttatattcttcttacattttgcc

SEQ ID NO: 138653 - DNA, 2083 bp, Homo sapiens
tttagatcaactgccaatcattgttatgcttaatgcccatctttattccagactttctgagacattaagaaagcttctaaaaacaaataggatcttatggctttctagttaagggtttttaaaagttaatttacatagtttaaaattgttatgtgtggttttaactgttcaggatttataaatatggtttattaatttacagctaaaatgctgtcagggtatgctttgaaaaatttgaactaaatataataaaactacaattaaccaggtttctttttgcactccactttcaggagacggaggcaattgtcattaaaacaagccgatttcaaggatatattcaaaaaatcaacttcagggtatgtccaggggtctacatttttcctcacctttttttttttttcagtgcgaattggttttcatgaaagaccctgagaatactagaagacagttatcaagtatagttacagtaatggctagggcactgtgtttattaggaaaaaagtatgtaaatcatgctgttaaaaatgccacgcatcattgtattgtgccttatattttccaacatgctttcacaaacataaattactttggttttcacgacaacactgtgagacgggcaaggaaagcagcattttccctattttacagatgggggaagataacactggaggtcagaaagctaaccagggacacagctgcagttggaccacagatgcctagctctgtctcttctgccttcttcctcatggaaaaagtttgaaacaagtttttaactttttaatctgtattacacaatcaagataatttgttttctaattgttgtacctcacagtttcccacttcgcatctgtctgtctgcctctgtgcctgtctgccagctggagaccttactttcagactctcccagacctagaaggatctggagtgtgggagggcaagataatggatgtacagtttgctatgacaactggtgttgagcagccagtgttcatatgctaaggcaggccagggactgagaaagaagacaatcttactatagctaagagatattcagcaggaattagcaaccttgactttaaagcagtgtttctctaatagtttagtagacctggtgtgataatcagctgtagtacttgttgagaatgcagagtactgggccccaccttcagatatctacattttaaataatcacctcatgtgattcttatgcacactaatgtttgagcacatctgccttaaaggtaaagaacttttcttttggtatatgtattgcagcatagagaaaagaaccacttttctctcagcaacttctgtgttccatgtcaaaccatattaaccagggcagtggggagcaaggggcaagcaagagtgatgaatgacagatattatttgcacacattgctggatgtacatctgaagcatgtcacaatagctactgttcattgtggtgactttgacgtattttataaaggtttgtgtctattttagacatgaggggcagaaagatttctgccaaaaggtgaaaaataagtgagttttgatattttaataacatctcccagttgtttttattgtaaagtaatttaaaaaactgtatagaaaactaggctattcagggttctggtagttaagggtttactgtaacaatgtatttacactaatttgtgtttcctatgtgtatatctagtctgcctgattagattataatggtcttgtggccagggaacatgtgttcttttgtgtatttgtaacatctagcaaagtcataagttattgatacttattgatgactgaaataactcactgagcatgtatctcctttctaggggttttgggctaggcagagtaagttgattgatttcatttgtgaagttaaaggagacaatcttacactgtcagtaatggttaatatactaagaagttttcagttgaaataactgtattttagttgacagatgtgaaagtgtggtcctaattaataaatgtgctttttccctgtttagagtatccattcaagctcgatcttgcctcttcaccctttttggaatacatgttatgttgttctgtgctttacaaatct

SEQ ID NO: 138654 - DNA, 5380 bp, Homo sapiens
accccaaaaacacactggagatagtggttaatgatctgcatcagttagccctcagagctgcaggaacctccacacccactccctaacctatgcatgttaaaccatgttgtagataagctcttccctttggggaaccccattgtcttttattctttatattgttcattatgtaaatattcttgatatttctcctccaccagtctgcacaaaggagaagccagaaaatggggtgagaaagggatttgagacatttccttaagcctaaattataattctctcattggaacaggattcatagatctttaatcaaatatgtttatttttctctgttttgaacgttaaaagggcttgttcgcattgggccctcttgtgtgtcatttgtatattttgctcttgactgctcagcataccatttacattaccaggtattggtgatgtgcagtgacttgcttggttgaatttgctatttcatttttttgctccatgtagtggagcagtgattgttaaaattggattttgtggtttactctttcgtcatgacttgtagcaacagtaatttaataggatttaacagtccaaagaatatactttttgtccttttcatttaccagtccacaaaatgactgcttttaggagatattgtttcatttttcaatattccctggcctaggtggtaacaaactaataaaatgcattcatttgctttaccaatcctatcttgacttagaaagttgattactgacatttcccttccttatggtagttaagtgttttccttactcagttcagttcagcagtcacctattgatccattcacacccccatcctcattcttctatcataaagttattatatacctactatgctgggccccctgccaggcacacatagggtctgtcatgcaaacatcaaaaggagccatttaggtatgctatgtgcaattgtaacattttattttttcttatgattcaaatcttagttttgggaggaaaaggccctttaatgatttcttatttaattatcatcagaaaagtgtagttaggcatggaggagggaagaacctacctctgctggcttgatttcaccaaaatcgcctcctataattgggttactatgtgacaggcactgagttaggtataatacaaacataaggaaggcccaacctcagttctcaggaatttatagtctagggagacatagaagcagttttaacccaaagagagaggagctataatattcaaagtatcacaggaggatagcaaacccattacctgtatcttctaagggatgtgagggaaagtttcactgagggaggtttgcttgaacacttaagcatgactagaagtttgcttggtagagtagaagggcagggaattccaagtggaatcagatgtgaagtcactgaggcatgaaggagtatgacatatttgaaatgtatgccaagaaattgctaattactagatgaaagagaactctgtggaattggcattgggaagatatttctggtacaggtataggttgatcatttatgtaacttttgtcatatagctattctgtagcttccattaactattccttacttctcctctcctccagccatttatgtgaagactttttttttttttggaggggaggtgtttaggagtcatatttgtagtttttccttaaaatgaatattaatataaatattaatacaatacagaggtgactaataaacaccaaattaggtatcaggagacctggcttattgttttccacttctctcagcggctatgtcacttgagccaaggcatttaacagctctgtttcttcatgagtaaaatgggaatattaatgcctgcattgcctacctcaggatcaggttgaaaatgaaaatgaaactgttaaaaataaagaggtataataaactcttttacttggaattctgctggctgaggttaaactgacatttaaagcaagtaaaatactttgtggagtatctggatagaaaaattaggttggaaaataattcttacttcctcattaaccctctatgtctgccctttagtctttgaaatgtcatttagcttatttctatgtttccaaactaacatgataaaaattttaaacttcctaatgttctggcatgtatatcttggccctttcaaattctcagtgtaactattaaatagcaattgatttaagagttaggtgagtaaaatataagttggtatatttcgtagtcaatcttgaataattcatacctattaagtagtttgaattactaatgagatactgtctatcatttcttgttccatatggtggtaggacacaagttttgttccattttagaaatgtataagagggtcctgattcattcaattaggattgggaggttatgagactttggccttctgccttctttgccatttttcctaattcagtgacaatgcaggcagcagttattagtagcagcaaatgacatttccattcattttatttcctttgacccccatcttccccattagattgagtggtaatctactgaaatctgataaatcacttgaaacatgaacttctagactataggagcatgagcaattgcttccaatataaatactcctggctaacccttctttagatcagtggttctcaaaatctatcactatggatatttcagcaggacagaaaattctgtaaaccacttaagtcatcctgctctgaaccatcttacatacatcagaagaaagggaaagagtactgctatggatgagataacacaatggtattttacatggaatgtaactgaattatttatactagactagtattgatcctgtcatcataatcactattatatgacacttgtggaattccaagaggtagttacccctcctccctttctgcctttgcaacttagagatgaactagttatgtgaatttggataaaacacctattctaatcaaaatataatataaaatggttgttgagatttttctaccaggccctaaggaaataatctgtcaatttgtctgtttttcacaaaactaaatgaggaaatggtctggcttattttctctttgttttaaaatctatggtgccattgatacccagtttaaaaacattcttctgaaggtgctgttgattaaatcattttaatgtcccccaagtactgcctgtttttgaagattatttggaaaatgtggcacattcaccaactcacattctcctcttattctgtacttgctttttttccttataagttagtggaaaggcaactggtcagttttttcactcaataaaaaagaaggaaggtgtagacagcttttatctgggaatgctttaagtcattgagagaatatttttaagtgttaactactttttgaaattattggcagaatcttttaatccattttaacataaaacagttgactaagatggaaagatttttattgtttacataaaagaaatcaccatggtttttgcatcattgcataaatctaagagattgtgcatacataaaaaggatgagacaaagctgaatgttaagtgccaaaatcaacgaaagcttgcgtacttactgggtatttgacactgagcataatggaatgtggttccacagagagagaatactaaatatttagacccaaggacatgtttctctgatagcttcttatcctaatctcctagctaacattattaaccctttttgaaacacctctttcttacacttagatttcctcctattaaagctcacccttggagattctaaaccttctatacccaagcacctacactcacccactcatctctttctgagatcttcatgaattccttttgtttattatatggatctttgggtgaattatcttggtttactatgagtagtaaagcacaatcacaatttctctccacttacagctctatttttccaaaggtcacagctccatcattcagctcttctgtcggtatccctttctcatcgattccctggaatttttgaaccagggctgtgaggtatacagccagcaatgttgcatagtactttagagttgctgcccaacacaggtccatctctcttcacaattcatgtttgttccttttcaggctcagagtggtgaaggaagttactaagattagcgtgcactatgaagtctgggaggtgggctttcagggacctgcttacttactctgaggctctgacctttgccttagtgtgattttctcaccatcctcttttattttgtgggcaaaggatcaaaaagatttcttcaacattgagtgctaaacattagcaagaatgcgtggtttctggtccctgtaatgaaagaatatttttaaaaccatagactcaaattaccatgtaagatatcacagaagcaaatggaatttgagctggatctggaagaatgggttgagttcaggaaagtggagtttggaagagatttcatgcaagagggacctctggagcaaaggcgagaaagaacaaagaaagcttttgacatagagaactggaagttggtgttatgatttactacagtaaactggaagagtaggttggccggtatgtactgagttcttagtgctaggcttagttacttgattaattatttgattgatctactcattcaacagattgtttctcatagcccacaggataaaatccaaacctgttttctggcgtgcatggtcttctgtgatgtggtttctgcataccttaaaatctactccactcaacactatgtacccacttttcagtaatattgaactcttttcagtcatatcgaagaatttgctgatccctgcaacatgttgtattccttcacatgtttctttctttgcacaggctatttcttctagagttcacttgatgtatgcttcattcttcagcctcagttgcaacggaatttttgttattcctctgctgctgtagaatgctaggcttatattactaaagcttctacaccatattttgtattgtcagaatacatgcctgcttccctcactcagcttatgagcttcctgagggccagggattgtgtctggttcacctttacatccacaccacccaacatagtacctaacatgtagccaattcaataaatacatacttactgtaaaattattcattgatcatttactttacatcatgtgtagttttatttttaaaaagcgatctagatggaatgggattgacaaattgaagacgggcaatgcagggagatgagttatatgtatttttgaagtagctcatttgtttaaaaaaaacagtaggggctagattcctgggagattgataaagaaaaaaagataggacttaatgactggcaactatgggcaagagagagggaagaattaaagataataaaaaataaagataatacaacaaatagcaggata

SEQ ID NO: 138655 - DNA, 1056 bp, Homo sapiens
ttctcactttcaatgaaggtatcttttctgtgttttttgaagattaaaaacttgtgagggtctggttttatcatgggtgaagtaagcgtggcaataattgtaagccaaatctttggctagaagatctagccaataaaaataataagagggtaacacatgaaattctgagaccagttactttttatacattggaattattttggtttaaaaattctgtaggttttggttatccactattattgtcataagatcttatggtagacgcacatgaaatttatcaccatatttgttcctataactgaagagttgcatgttttcatacaaaggatatgggcttgttagtaatgttgcatgttttatatatttgaaggaattttccaggtcatagaaagtatatctgttcttggggagaataattgctactccaatttcagtcatcctacctatcttgagtgttgctgttcatatttacattcttcctgtgcaatctcatctaccgcaattatttcagtccttgcctacatactaaagacctttcatttatagctcgagtctcaattttttctgagtcccagactaaaagttgtttattttctccctccacaattttttgtttgtttgtttggactctacaagtaatacatatttattacagaacacttagaaaaatagaaaattatatatatgcagggtaaataatcacataagatagcctctgttaacacctcgatgtattttcactctagtcttctgatacatttttaaatgtaactaaggttttacttattgaatatgatctagttatagtagtgtggttaagggtgaggctctgaagtctgccaaatataggtgtcattcaaactctgctacttactagctgtgtgaaatttggaaagtgtcttaactcctatgagtccatttcctcatctgtaaaataaagtgatatcactgtgtgggattgttctgtggattaaataaaatgtttgtaatatggttaagttcctgtcatatggtaaatgctcagtaaatggaagcgcttactgttttattatacta

SEQ ID NO: 138656 - DNA, 1035 bp, Homo sapiens
actttcagttttttaaataagattcaatttcttaattttcttaagatgtaatatgaacattaagtacaggggcatacatttttcctttaattcaaccatgaaaagtataaaaatattataaaaacagaagttgaaaattccagtgttaatcttcatagtaaatattggcttcttttcctcctgaacaggtcattatccaacttttagaggtgatggatcatctgcatagaggggaattggttgctgcaatacttcgtaaccggtatatttatggaaatagtttaacttatataacgtctttcctatttatatacctaacatagcaggcattcaataaatatttgttgaatacttggtataaagtaagtatttactgtatgaatgagttagagaatgactaagtgacaaagaaattgaataaagaggatgttagtgacaatgtttcctgagataatgaaaaaatagagaatatatttagaaaatgtaattggtataaattatgagcacctggaatacaatcagtggagatatttatttgaatttttagttttaaaggcatatctgaataaatacaggtatccatagcttaagaatagaagtgccaacaacacatttttaaaaataggattgtcctgtgattgtatatatttatattatttaaaaatccagttaaaaccttttcagggagttactatgagatatttaaagcttcttctgacaaattaggattttaaatttattatttaaagaaaaatagccttgtttgcaggtgtgacagagtctgtcttattcccagtagcttgattgtacagtttggatgaaacatttggaatagtatgtttgagttgtctgtatcctggctctgatgcttactagtggtatagccttgggcaagtttcgtagtcattctatacctcaatttcctcacctatgaaatggtgttaataatagtacctacattgcagggttgttgtgaagattaaataagtgtgaaaggtggggcatgtatgaaagtgtgtgtgtgtgtgtgtgtgt

SEQ ID NO: 138657 - DNA, 1030 bp, Homo sapiens
agaaatccaggcacagtaggagggttggttgaaataagaagactgtgttattctgttttgtgctgctataacagagtacattataatttatatataacagattgatttacaatgagcagaaatttatttctcacagttctggaggctaggacgttcaagataaaagaggctggcatctgacaagggccttcttgctgtgtcatcccatggcagaagttggaagggcaaaaagaggcagagggagagagagaacacacaagaggaagatgaacttgaacttgtccttttataaggaacgcattcccatgataatggcattaatccttcatgagggtggtgcccccatggctaaacacctcctgttagaccccacctcccaacagtgttgcattgaggtcaagtttccaacacattcttttttgggggcacattcaaaccatagcagagattaagagaaaatttgcatacctaatttcaggacctgtatgtttcatcctagatgcaattagtgaaacagggcatgagttatttagttttacattatcagatttctagtagtaatctagatatagatttttcccttttcaacatcttctaaataattgtatagtctaaacataattaaaaaattttaacatctcaaattctctcatcactttaacatgttttagaaaaggtaaatcgaaggtcagttcatgtgagagtgtgtaaaatattaatttcatttaacctactcagtttctttacttgtaataacagaattataagcagaaaaatgattgtacaaataaacataaatgatgtcatttgatttatttgctttttagaattatgaaaacccaataaatagagttttttttcctcttctatttcttttccttaaattcaggggctggaagagggctgacgacaatgaagaatccctcctcctgcttgcttaattattttagatcttcacataacttcttttttctttttcttttcttttattattattattttttgagacagggtctcactctaccaccca

SEQ ID NO: 138658 - DNA, 1370 bp, Homo sapiens
tttcagtagatacggggtttcaccaggttagccaggatggtcttgatctcctgacctcgtgatctgcccacctcagcctcccaaagtgctgggattacaggtgtgagccaccgtacccggccataaattttatttttcatatgtctttcatacatcttttaaagcacatttgtaagttttttttttttttacaaactttgctgctctcaggtaggtggtattttttccagtacttatagaatatgatattggtggaatataagaaatccttgttttcatggacctgacattcttgtaatgggcctctcattgtgctaatttttcagttgatacttttgcattttccataaaccttatgttacctataaatcattaatttttagacaatcatttatgatcctgcagcagcaacattcctcaggaacttgttagcaatgcagattctctagaccgatcccacaccaactgaaggagaaactctttccagcaatttgtgcttcacatgtctccaaactctgatgtatgctcaagtttggagaccactgatgtaaataataattttatgctgtcttgctcatattttcatttctcacattttttaaattgcaagatgtgtgtgtatcagggctcagtggattacatagaatgagcactgactgaataggctgagacaaatcgttaacatccatgggtaagatgggaggggaatgatgagacatgaattattccttaatttcttaattccttaattaggtgaataaggaaaaagtaaatcagagagagagagagagaaggaaagaaagaaggaaattaagtatacaatttagggtgaggattttagtggttgacagagggaagtctgattcaaagatcactcctatagataagtaagaattgtaacattatgaaattgaaagaaataaagacagctaagcctaagcctggcatttgatacttaatgaatgtttgtaagatgaagttcagtctttgccatatgagggtcaccaccattagaaaatcatatagaattgcattaatacaaggataatactttcaatattggcaaaaaagccaattgcaatgatgagtcagatgataccatgagccaacaatatacctcaaaggcattcctaaagcctattatgaatgacaacatgagaagggactaccaagggatcttgtcaggaaagaaggaggccaggtgtggtggcttatgcccataatcccaacactttgggaggccgagacaggaggactgcttgaggccaagagtttgagacaagcctgagcaatatagtgagactctcctgtctaaaaagaaaaaaagaaagaaagaaaagacgggaggaatgatattaagcagtggaact

SEQ ID NO: 138659 - DNA, 1039 bp, Homo sapiens
gccaccctttgagaagtaggcgttgttatcctagaagcagtgaagaaattaaaacacacagaaaacagctagcaaatatgtagtgaggctagcatttaagctcaagtctgtgtgactctacagtttcttctctcttcactctactgtttgggggtatgaaagtatatttattaaacttttctaaaagaggctataagtaggactatacagaagctattcagttcattttcttgtctgtgtgcttaagacagtctcagtgtcaaacatatgataatcatttctccatatctggagcaaaaagagagtcatgtcagttacctaatgttagtcacttaagcacatggattttttagaggtcattacagtgataaatcaatattttaaaatagcagtggcttcttcagtttggagagaaatgttttttaaccttatattctaaaccttaatgcatgctaaattgggaattggagggaaaaagggaaagctgacctttcttttttagtctgaacaaacaagaagaggaaagcaaagactggctaaatagtataaggcagtattttaagctttccatgtttattcacttgaaacctgttatttttcaaaaacacatttttaagtgaaaaatcagaaaatatatatgctttagaaattattgttaaagacaaattttgtaacataaatgctttatgtaatagttacataaaacaagtttaagttgtctggtattgatgatatagaggaaaaactatccttcaaatatttgtgaattttacctgtgagttaatgatggtttaccttctaatttatcaacctaaatggccttgtccaatacaattaaaatgaacaattatttggtttattgtaacttcagacttagtcggaaaaaaatatataacagctgctagggtgtaattgctaaaataactataataatttttgtctctgcatggtgaagaatatgcattaagactttagcaaaagataagactgtgctctctttgtaagtagtctgatcaaatgtggctcatgacttaaaatt

SEQ ID NO: 138660 - DNA, 1722 bp, Homo sapiens
tttctcccttctcccctatattagtctgttttcatgctgctgataaagacataccagagactgggcaatttacaaaataaggaggtttaatggacttacagttccacatgactggggaagcctcacaatcatggtggagggcaaggaggaggaagtcacatcatacatggatggcagcaggcaaaaagagagcttgtgcagggaaactcccctttatataacatcagatcttgtgagacttattcactatcacaagaacagcataggaaagacctgcccccatgattcaattacctcccactgggtccctcccacaacacgtggaatttaagatgagatttgggtggggacacagccaaaccatatcatcccccaatatcatcctctctacatatacttggctgtggatataagagtagattgactgaaatttcagccctacctgtactaggggttgatgttaacattattgtgatacaaatgtagaatataacaatagaaagtcatagaagagttaaggaataattttgaaagttgtgggaagggatgtttggaaaagaatggttaaactttctaacaatataaagttggctacccagactgtatgtccagcttacttttgtaacttttactcacttccaccagtcatgactacccatttctcttccttgccagtaactgtcatgtgagcctgcctctatttcaccctcgtatctgtcagggaggtcactctagatcaaatcctactgtttcaatgctgggacagaccttaaaagattttattatcttcctacccttaacatactttataaatgaggaaactggggtcctcatagctaactaatttgtagcaaagtagagattagaaaaaatgtctgtcctttctgactcccttgtcctattttttctgcttttttccattttagttgctcattatagtcacagattttgctatctgctgattactggaatgttctacctgtataaactgttaaaaaactgtttgtttcttcttaggagtctccttggtgtgaaagaacactatgaccttagcagaaatgtaggttctacctaagggtttgtttgtgaagtaaaaccctcaaccataaatctgtcagcccttgtaggttgagaaaaaactggttctcataagggttcagaatctcttttaatgcatatttatgagtctgacctggcagcagacattcatgtgtatttcacctagtgtaataaatttgttggcctcatcctgctgtgggggttccacctgcatttttcttagtaaatcgtgttttcttcacttatcatgcaaactgccaggccaggaaattttccatggatgtccccactcctttggattatgctgctgctttctgtatgagctggctggagcaagatagggtaaataccacacatctttcaagcaggtcactgaatttatgaccatggcaaacattttccactggcgattttgtaagagcttattgtcaagttgtaaactctatataaaatctctgtgcccataattattatctacatttgaaaactggacctccagtaaagtcatttttgattcaatgccacccacccccaaactgtttcactataaaaatttgataagattttcttaggtttgtgaggctgcttctctttcttttctttcttttcctctgtcccaacatgtgcacattgaattatccctcccgaagtgttcccttccct

SEQ ID NO: 138661 - DNA, 1173 bp, Homo sapiens
aattgtttagattatctgtgaggctttttgactcagtatctcagatcattgctcttttcccaagttcaatacactacagttaatattcttgtgtctgtaaagcttctgagaggtgacaaaggttgattttagtctttgttagacaacatatatgggttaactaggcaaagtggggaacggagtgggcattccaggcagagggagccacataagggagataaaacataaaccacagcagaaaagtcagtttgtttgctgtgtgtggaagacgatgagaattagcaagtgatcaggtccatactgaagggtttatgtgtaactcaaaaaaagatttttttatactgatgatactggggagccactgaaatactttcaagcaagagtgacttcagaatagcattagcagtatttctcaaaatgcagttgaacaaactgaaggaaggcaagtcctgaagtcagtggataagttagaaaactgatagagtaattcaaactaaagaatctgaactaagaaaaaagagagaggaaggattaattgaaagctattgaatggtttcactactagaatggatgcaggagtgaaaagtggggaggaataaagactaaagctcaggtttctggcttgcttggtgcaagacctgccattacttggtgcaagacctgccattcccagtgacatggaataaaagaggaagggggagaggaaaaagaaaatcatgtaggataggatgaggagttaaattctgggcaggtaaaaatcaaagcactgtgtgccatccaagttatctactagacacaaaagaattaataaatttcaatgagatctttcttattatcaggagatattctaactgaaggttgggtatgctttaccaaaagttcattatttgctcactagtgtaatagtctgctaggttctatttctgtgtcataagatatttgtgggaaaaaaactgttttcaaatacttcattaaaatagttaagacagtttttttttaagtaaaagcaagtttattaagaaagtaaaggaataaagaatcgctactccataggcagaacagaccagtttctaattttatgtttatttgagcactagaaatttcagcattagtgattattaatatttataatttattttacaacagtttttgtcccttctatttcttcttcct

SEQ ID NO: 138662 - DNA, 2003 bp, Homo sapiens
aagtataatttttctgtgattccttttcctactctgttggaacatctgctaaactttagcccatcatacttcttatgcttgtataacaacatgaaaacctgtaataaccagtttttggcatcatacattattataagactttgtcataatatttcaggaaggtaatgctgttgaatgtactaataagttacaaaattaatttagatgatttcctagctataacctattgaaaatcatttgttttggtttccaatctgattgaaatcctaaaaatacttaaaataatttacagagtagcatgtaataggaatcgttcaatatacatcagcacacatcctgtgtattcattacatgaaatggtactcgaacattgtgaatataaagttatggtatagttttaattaagactgtggactctaaacctgacctaaaatctgattctgtcatttgctacttgtgttacttcattttattgcgtcatggtttcctcatctctaatggaggaacaagagattttatagaaattagataaagtagtgtatgtgagtgttaagcatagtacctagaatatgataagatttaataaatgttagttattattttatataactagtattatctggttatgaaaggaactttggcttttagtttcaaatttatctttctagccattttatttaagacgtttatacaagaagaaatacataaagaatgaggtaaatgacaaattagcaatgtaattgttatcaactagtggaggcacttttagcaggcaaattactcattattatggtcaattattttggcaaataattaaagaaaatgaaaaagaagaccaccagactatgaatgactttgcctttaactgatgctgatagaatttgttttaaaattttttcactattaggaagtagcctggttttgactaaactttttaaaaagaaaaaaaagtttgtttgaaataattacagattcacatgaacttgcaaagatagtacagagaggtcctgggtacctgtcacccagtttccccaaatgactacatcttatgtaactgtagtatattttcatagcccagaaattgatattggtacaatgtgtgtatatagttctgtgacattttatcacattatggattcatgtaaccacctccacaatgatgatacagaaatatttcaccataagagacataaattacagaactcaagaggagggggaaggaaagaaaatttgttgtattgacacatattttgcttaccatgttctttcttccttcctgatgttccaagataccctcttttatcattttcttttggtttagataacttcttttaactaatagggtaggtatgctggtgacaaaatcttagttttcctttatctgagaatgctttaatctcccctttattcctgaagattttgtttttgcttgatataggattctgagttgacagttcttatctttcagcacttgaaaaatcctttgtgtctcttctttatggcctccatggtttctgatgaaaaatctgctgtcatgtgaattgtttcccctgataggtaaggtgtttctttcactgctttaaaaattttttatttgttaacaactttcaaaagtttgattatgatgtggtttagagtcaattttcttattttatttatgtattttttaatttcaatatgtttttgaggaacaggtggtgtttgattacacgaataagttcttcagtgatgatttctgaggttctgttgcacccatcactcaagcagtgtacactgtacccagtgtgaagtcttttatcccttgccacccccatccctttctcctgagtgtccaaagtctaatgtatcattcttatgcctttgcatcctcatagcttagctcccgcatatgagtgagaatacatgatgtttggtggttttccattcctgagttacttcacttagaatattctgatatgtatataatgatgctacctttatccaggttgctgtgaatgccatta

SEQ ID NO: 138663 - DNA, 1025 bp, Homo sapiens
tgaaggctgaatgggtcatgaaactggcatattgtctaatgtgccaatttaaaaatatgaacttaatgggttctcgtttttgctcaaaagcaaaaacatgatatactatcaattcccatgataattaacataacaatatcagtgtttttcttaatggagaaagtgagtgtaagtagcaagcttatagtattagtattgcatatgtattagtcatgacataccatagataattgtataaattttcacgttacgccaataaactgtaaaaattccagaagtaactgagaacgtggtagcagctgcagcatcggcccatgctattttgccagccattcggagactgcataaattaactagtggcatgaactctcctggtgcattttggagccattttattcaaaaattgttttgtagaaagtgaaaatgttatactgtattttggcaaaaataagaagaacaataagcagagctctctttagtgtattaagcatcatctaaaaatgaaaagcgtgaggggagaacctttacttcatgtgcctgtgaggaaattttgactttgtatagacaaaaagtatgtacacagagaaagatttgttatataaatagtatagctcatttgtatagtcaagggtgtcttcctttccttccttccttccttccttccttcctttcttccttccttctttccttccttctttccttccttcctttcttctttccttccttccttcctttcttctttccttccttcctttcttctttccttctttcctttctttctttgtgacagagtctggctctgtcacccaggctggagtgcagtggcaccatctcagctcactgcaacctctgcctccagggcttaaggaatcccccaccaagttgctgggactacaagtgtgtgccaccatgcccagctaattttttttaaaatttttattagagacgaggtgttgctgtgttgcccaggctggttggtctcgaactcctggcctcaattgatccagctgccttggcctcccaaa

SEQ ID NO: 138664 - DNA, 1538 bp, Homo sapiens
tttcctttctattattaaaaaatgaccttcagacataattaaatgtcttaaagaacataggtgtcttttaaaatgtgttaatcttaggttgctctctttttcttcttacaatttttcttacttttaattttaccgaatttttctttcagaatgatcttgaaatgtcattttacactttttcagtatttttaaatgcctattatctacttgggttgtttctactcaggggccaaagtagttttagttgaagttaaagtgagttgataaaatgatttcctgtgaatcttaagtaaagtttttatttgcatagatggaatttctgctttgccatgtatggcaaaaggtgtggtgatctcacagctagtaggtaggataaaatcaattaaggtggcactgctgtcactagaataaaaaatctatgcatacctttatattaattagatgaaagctcctctttatcactaagctcaacagttgacatcacctggagtcagggagtcaggtgccgtggagttaaaaacagaaagcatgctcgatttagaaattctggcatatatgtatgatgctaccttttctcacaactagattttggttattaagccattgtgatattgggctatgttaaaagacattagaaacctgttcatttaagacaagccaaattggtctgatataagagggtcatgctgaatgagaaagtatcacataatttaggagagaggattttgagtaatgtgaatattgagttttctgtgacttggtatatcatttattgattttaaaaaatgaacccattacattatactcataaactattacttcacaatagtttgattttctgcttaaatcagtgcctaaaatggtaaagtcttaaatggtttagaatgactctgcatgtaggttaggtccatctacctgttttatatggggatctgctttatctgcacataaagaagattcgctagctttaattagccttactatgtagggcagcactttctctaatgagagaaaatgaggtattttacacaaattaattcaacagaaattagtgactaccttctttaaaccaggtgatggggatgcagtggtgaacaaagttctatcttcattctatgaggtactcacagcattatatgcactctctttgttcttttctaagaacattccattcaaaggaataggaaaagtggcaggagaaaacacactcctttcctttaaggatgtagtttagcatttgcacacatcacattcacacatatcccactggccagaacttaatcctatggtgatacctaagctggaaaatgtggcccttcactgcatggacaagcaaaaataattattactatatgagccgggaagaacagatattggggaataactaatagtctctgctatacattgtccctaatgtaaacctttaatcattcatcaatttttgacttatctggagatattatctctatgacatcagctacacatttgcttcatggtaaaaattaagacttctcagcagagtatacaagtccatcatg

SEQ ID NO: 138665 - DNA, 1050 bp, Homo sapiens
ctaatatgtataagaactaggagtaaaatccatgtagtctgattcttgagtctatgcttttaaccacaacacttcctttcatgctatctctgacagaggccattatataacagagcatgatatctaaaaaaggcatgttagaaaacagattctagagaaataaagagaaatgatcagatgagggtgttaaagttggaaagatagtttgaagaaggcacttttaaaggaggtcttattgaaaagcaaggaacgtatttctgaatatttcaatgctcaaagctatgtgtacatatgtgcatgtgtgtgcacaggtgtgtgttggtatatgtgtgtgggcgtgtttattttaaactggaaaaaaactttagaggttaaaacaaattgacaatctttttactgacagctaatcagagctctgtttttgtgtacaatattttgacttcacaatcctgtgtcgaaaaaaatatttaacggctttattaagatataattcactcatcatacaatttacctgtttaaagtaatataattcagtaatgtttagtatactcacagagctgagcaactgtcaccacaattttagaacatttttatcacctcagaaagagaaatttgttttgaaacaaatgtggccacaaagaggatggaactagtgtgtctgttggtactactgcttgtctatcaaaatgttcatgatttatgctcagtctaacacagacctcatgctgtttttctgcagtctagctccaaattgctgtagagctcctcctcctttgaatttaattttgatcggtgacagtctttcaaggcagtatgtattgatctaattttgaattctcaattcaagttgattgtatatttgtatttgtcataaaggtattgatcttagttctaaatagcaaagccagactcgtatttaaaacaaaactgctaaacccactagtatgagtggctacctccttgtctgtgtatgctctatagtgggccagagccaaagatttctgagaaattttatgtgtatacactgatatttttaattacttctaaaag

SEQ ID NO: 138666 - DNA, 1934 bp, Homo sapiens
gccactgtacctggcctgtttttttttccttcggttttgtggggttgccagtaattacatgtctcaaaggattttttctgcagttttcttgcagttgaaaactagtccttgaaactattctgccaattcattcaacaaatacttattaagtgcctattatattccaagcattgtgctagtctaaacaaatagaatctctgtctagtgctctttccattactttgggtccttcaaagtggagcacatgtactgattgagcagggtggtgacaaggtggtgctcccaggagccacaaaataaagcagcttgtattttcttgaagcatctgttttacacagagatttaggagaacattaactggtagctatttaaaaatctttaaacaaattcagatacattctgccttagaacgcaatattcatagaaaatctgaggcaaaccccaatatttcagagaaagtctctgcttgcaagggcagctgtggtaaccctgagatgaccctttggaaagcactgaggtggtgctgtactgcccgaatctgttcttttagtcaaacacccaaacattttcatagccgtaaattcccatgatgacctgtgggaaagttaatggacataaatgtttttctctgttgcgcaatttcaagggtacatgttggttacccttggtctaatggtctaaatctaaacatgtgttgagttcttacagagtttttaatgttggtgggtaatggctaagagtgactatgaaggacctgcctagggaatgatattttcagaatagaggttattaggcctgacgcagtggctcactcctgttatcccaacactttgggacgcctaggcgggagcattgcttgagcccaggagttcaagaccatcctgggcaacaaagcgagaccctgtctctataagaacaaaaaaaaatttaaaaattagctgggcatggaggcacacgcctatagtctcagctactcgagaggtttaggcaggaggatcccttgagcccaggagttcaaggttgccgtgggctacaatcacaccactgctcttcagtctgggtgacggagtgagaccctgtctcaaaaaaaaaatctaaaaaaatttttaaaaaaggctagaggttattagaacacaaggaccacaaacttaaagcagcacagttcatggtgtcaaagctttgccttgttctgtgcacacttgcctgtctcactgatttgaagttcacttttgctaactttaaagctgctttcatttacagcatagtatacaaattggtttgttaattgctggccactgaaatagttaatactagaagaaagttgtcaaggattaagtgctttgaggttgataaaaggtttctacagtttgagatggttttgaaaataggccagcagagcattggaggaatgcctgttacaacgtgatggtttaatttgctccagatgagaaagatgaagaagaaaaaggcaagtgaagaaagggggtgaaagtaaatggagtaagtcaaacactaaatctttcaactgattttcattattgcagtcccactttcattgttgttgttccatgccagacatagttcacagggcctgacattgttatattgttgtgttactgctcaaatcttgtaaggacatgggtatagaggattgtgattagtggatggtctttatcgtctacaggtgaagtgcttttacagtctattcagtaaaaggagataagagttttgcttgtagtttgtagagttttctttcttggtcccacttttaaaaaaatggtgatacatttctaaagatcacttcatttcaacaaagttttctgttccactcttggatgtttcttttttcttttaagacagggtctcattctgtcactcaggctggagtgcagtggtgcaaagtcaaggctcactacagcttcaacctcccaagt

SEQ ID NO: 138667 - DNA, 2245 bp, Homo sapiens
tgggtgcttgtcaaatggatgccatgcctttcttttttgtcatttcaaattccaggtcctattacactattccccattgaactagatctccccctctgaaggtgaacagcagtcacacacttgccctgttgtgtcataattatgcttatttgatgcctggccatctccccacttgcctctggcttcatgaaggcgacctagacctcatccggtttgctcattgttgtattctgagcacccagcacatggtatgcactttataaatagttattgaataatgaataaatactgtcttgtgatgtttctcctattaattttttgatgttagatcatttaatactgttttacttttcacgtgtttggtgttccgaagtggtttctgagagaggttgtagagcatacttgttaagagctcaagctctggagctaggccacctaggtttcaattccagctaggagacttaatagttgtgagacactgggtgagtcagtaaacctccctgtacctcagttatctcatatgtaaaaaaggggtaatagaacttgcctcttatggtacttgcaaagattacatgaattagctaggcccactttttcttttctctttttctttttcttttttttagacggagtctcgctctctcactctatcgttcaggctggagtgcagtggcatgatcccggctcactgcaacctccgcctcctgggttcaagcggttctcctacctcagcctcccgagtagctgggactacaggtgcgtgccaccacgccaggctagttttttgtatttttagtagagacagggtttcaccatgttagccaggatggtctcgatcttctgacctcgtgatccacctgcctcggcctcccaaagtgttgggattacaggcgtgagccactgctcccggcctaactttttatttttagtggagacagggtttcaccatgttggcgaggctggtttcaaactcttgacctcaggtgatccacccacctcgggctcccaaagtgctgggattgcaggcatgaaccacctcccccggcctaggcccacaatttgtttgcaatttttaaatttctaaagctctgaaaactgaaaaagattttatttggtaacttagatgccaaaactcatgtggtggcaaaacctgacttaaactgacatagggtatttatagtctttattctacttaatgttgatctttattttgttttgctatagaattactaatatgtttatggggttgcaccatagaccctaatggtgtattacataacatatggtatataaagtatatttcctgtctaaaggtctggacatttctaaattcagaaacacatctggcaccaagatttttcgatgagattgtacaccttgcagtaaactgcttaaatcagggccttgcacatagtatgttgttgctgtgggtggtggagattagggaggtaaataaactactttatctttcccaatagcttgctcataatagttaccatgtaaatatatactgatttactcatgcaataactgtaaatagaggactggctgtgtggttctcatgtcataggaaaatagatatggcagggtcatgtaattgaaatgagccaagactcgtctgttagtactctcatctggtaccattcagagcagtttagtttttgtttttctgttgttatttaaaccaacctatgcttctttagcacaagagagtcttttgtgggggtgggggtaagaaattcagttaagaacttatttaatgtgattagacacttatttttttgcagttgttgaacatttattgaactgctaatgtgtatagaaatctgtattaagagcaagagaaggccgggcatggtggctcacgcctgtaataccagcacttaaggaggccgaggcgggcggatgataaggttaggagatcgagaccatcctgaccaacatggtgaaaccctgtctctactaaaaatacaaaaatgagctgggcgtggtgacatgtgcctgtaatcccagctacttgggaggctgaggcaggagaatcgcttgagacagggagttggaggtttcagtgagccaagatcgtgccactgcactccagcctggtgacagagcgagactcagtttcaaaaaaaaaaaaaaaaaaaagaaaaagaaatagaaaagtagaaaagagaaaggtagaaaacaaatgagacatgattcctgaccttccttagccccagcgccctgcatggttacatgggga

SEQ ID NO: 138668 - DNA, 1064 bp, Homo sapiens
gttgatgaatatttggattgctaccaacttttagctattacagaaaactacaaacaatactgcaatgaatatccttgtgtatgcaagccaaaagctccatcagaggttatgaacatttaaaattttaataaatactgccacatttcacagcagcttttaacttgatgacagttcctgcaaaaggtggagcatgttcacagagactacttttcctccagatgaatctataagttgtttagagggccatagtgggccctcttctgtcctgtcttttagagaggcccattctgggtaatttttatattcatttttggaaaatgctgatctaaagtgatcttttaaactttacccagtaggctttcttaaaaatttaatgaaaaacatactactgatgttgaaaaaaaccctatacatttggcattacattgtttgatgcaaatcttttttgttttcctttttggtcttctctactaacagcttgcatatgactcatttccatctcagcaataggattatgagtcatgattaaggcaattctccttttccattaaagataatgaactcactcatggatatgttttataatatatgtttacaatgatattgcaacataatattgaaagaatgtaattatcctatatctctattatgtgcaatatagttctattcaaaatgtgtttacctatcacaaaggttacatcttggaactatgatttttgttttgaaattagccctccactttacaacatgcatgttatggtgtattcattcatgatctatgctgtgatcttcatatttgtgaatatgtaatatttctattaaatataaatatacgttcaacccaatgtataatacatactgccactggcatgagatacaggcaagaggactgttccagtctatcattgcatcttgttttcctcttttcttgttaccatgccagcgatctaacagtttggttgtcactgtaaactcctgggattagccttctacttcaaatcaacaaagccagcattatccaattacagcctaagaatggcctaatcttcaaaaccagctgccat

SEQ ID NO: 138669 - DNA, 1049 bp, Homo sapiens
tttacttatttttctcatttttttttgtctttttttctcattgctttatagggtcttgtcagatatttaaagtattaatccttttctcacacaatagaaaatcttccttcctactctgttacttgtcttttaactttgtttaggctgggtatggtggcttatgcctgtaatcccagcactttgggagactgaggtacgaggattgcttgaagctaggatttcaagactagcctgggcaacatagtgagaccctgtctctacaaaagtttaaaaaaattagctgggcatggtggcacatactacttgggaaactgaggtgcgagtatggatcatttgaacccaggaattcgaggcttcagtgagctatgatagagccactgcactccagcctgggtgacaaagtgagaccctgtatctaaaacccccaaactttgttttggttatcttttgttgtacagatgtttttaatttttatgtcatcaaatctgtcaatttttggattgtgaatttggagtcttgctaaggaagttcctcctaaatgaagattatataaaaaaattctactgcgttttttaatacataatttttcgtttgtgttttttaattttttttctattttattatttttagctattagctatatctcccataaaaataacataggcataataataaaataaacacctacgtatccaccatccagcttaagaaataggacattttcaatatcttagaaggcccctgtgagctgctcctcaattacttccccctccctcaccaacagaggcaatcagtgtcttgccttttgttttaaacatttctttgtgttttttctttatatattaaccatatacgtatattatattgttttattttgaaaaaaaaatgagtctcaagcactaaacttactgtgttaggaaagggcagtattgtcactattaaataaaagatcccagaggaagagtctctggggcacatcttgtcttctgcttccctgagagtttatgagaattccttctaaggaaattagtgggcaaagttgtgagagc

SEQ ID NO: 138670 - DNA, 1041 bp, Homo sapiens
cagtcagcattggtatgacaacttgggagacatagggaatgattcccagaatctgaaaggaaaatgtaggcagggtctgttcctgagaaaagaggatctggagattgatatcaaaacccaccacagacccttgtagtttgctttattaaaatatatgtagtaagtaaacaagtagtgtgtatctgtgtgtgcatgagcaagaatatagtccttgctgttagagttcactttctgttactctctctgtcatttttttttttttttgagacgaagtcttgctctgttgcccaggctggagcacaatggcgcaatctcggctcactgcaacctctgcttcctgggttgaagcaattctcctgcctcagcctcccgagtagctgggactacaggtgcccgccaccacgcccagccagtttcaattactcttaacagatatctctgctgtcttcataaagtctcaagttaaagaactttccatacatcacacactgttatgggtgcattgcctgctgaccacagtcaagatcttgatgcctaaagtgaacaaagctacataagcagcatctcttattgcagtggttttcaaactatacactcaactggagagcctgttagaatacagattctgggacttcactccagatctattgaattctgatctctgggagatccccaaaatcagcatttttttttttttgagagggaatctctcactctgtcacccaggctggagtgcagtggtgcgacctctgctcactgcaagctctgcctcctgggttcacgccactgtcctgcctcagcctcccaagtagctgggactacaggcgcctgccaccacgcccggctaatttttggtatttttagaggagacagggtttcaccgtgttagccaggatggtctcaatctcctgacctcgtgatccacctgcctcagcctcccaaagtgctgggattacaggtgtgagccaccgtgctcggccaaaatcagcattttaagaaacttccccaaaatgactgtgatgcaggtggtccttaggtaac

SEQ ID NO: 138671 - DNA, 1050 bp, Homo sapiens
ctctctggaaccgcccccgccacctcttcgccccgcccacgtattaccgcccctccgaaatctcgcgagggtaggtgcgcgtcggtattttgcgggcaactagctcttccagctgctgtaaattgctgctgcgggagaaactggagccgctgtagccggcgcgcccttcttcccttactgcgaggagccaccgcctctttcgcgctccttatacacctatcactgggagcggtggcagcaacattccctggaccaaccgccgcctcttcaggcggccgctttgccggtcattcccgaagcccggcaactgagggcggccccctttccttaacagtctcctcgctacagatcgtctgctccctcagcctcgcccgagacccacttccccagtctcgcccgggtggaggtcgacgaggaggagacaagagtcacccttcctccaggcggcgccggccccctcacccgcgggtgtgtcctataaatggcgtcggaaagcgacaccgaggaattctatgatgcccctgaagatgtgcacctagggggcggctaccccgtggggtaagtgactgcagctatgacaggaagccgggcatcccaagccccccgcatctcctgtgtcttccccctacacccctcccaggtcccgctgtgtccgccaccgctgttcctccccgtctcactggaggacttcagaacccagacctggggcttcttagggcggggtgactcggagaagggggagtcagccacctcgggcagcctcccggccgtttccctactgaacggtcccagggtcggtctcggagcccgtttctcttctgatccagccttctgtgagggggaacagcttacgtgcctgagtcggagatttgtatctgtggggttctgagcttacctttcaaacatccgttttggcctcggggaccgtagattaaaggagcagtaacaggagaaatgtaacttgtagttttttattctcccgtttaccgctaacttacctattcacttcagaggtggctgtaactctcccctatttgccgtcctcttttt

SEQ ID NO: 138672 - DNA, 1039 bp, Homo sapiens
gttggaatgctcgcttgactaggacttgtatttacttacccacttctccacttttcaaagttggggtagtgctttaaagcgatttcgccgaactcccctacgaatgtacgtggaaatagaggcagtgaaatatattttcatgctgtaagaacttgaggattggtaaaatgtagatgttagtataaaggactaatatggttcgagaagttcactgccttcaattctcacacttactccgtgggagtaataacccgctgtgatgcaagtatagttagccatgcatgctagaagtcattctaaaaactaatgtatgtttatacacaatatgcaccaaaaagttacagtaataaaatcagaaagcaatgtacgttggtagatttcagatgtttgtctttccaccaaccttcatgtcactgttgtgggattttggggtggcagtggccaatcttgagatgacaccgaatctccttcaagttcaatatctgagacaagtttagagctaggtgtagagcataggaaatacatttgggttttgaaatgtattggacttccgtgaaacttaatttttgtgtgtgtggttttcccttcaaagtaatgaactgacaattcagattgaatgagacaccaagtcctttggtacttttgtgtgtgtgtattggggtgggggagggaaatcatcagtttatgagctgatcagtttagaactactctgtggatattgttctttccactgaataagtttaatttcaaaggacgcaagttatatcaggacctgtgtaaactgtctagtccagtacctgggcacagagaaagcattcaaaatgttcatgcttttctccttcctttcttggcattggcaaatttgttaactttacacaaagcttattttgggagatatatagaacttggacctattttacttatctaaaccggatgagtcattttgatagaattgatagagtcacttcttccctcatgagataatacagcttctcaagcactttgatcctctgatattaggtgaaaactgaaaaaggtt

SEQ ID NO: 138673 - DNA, 1005 bp, Homo sapiens
gagctattagtgcttcagctgtgggaaaattgtgagattatgcattgacagaattgagaagcaaattctacttcacgttgcagaaggctcatcagattttagattgatatagaaataatataacgaatatttctactacgctttttgtaaagtgaggagactgttctaaagtgactttgtatatgtaataactgaatccctttttaatgacaaaataattttaattgatatttatctagaaagttggttgttgatggttatttgacctatacaggttaacctcattttgaacatgttgactgaggacagtttcagtgattataagtcaaatcacatatctagagattttgtcaatgtattacagtagccatcttggttttgtggggcaatctaagccaaaaaataatgaagctgtttatataccttcctgctttttgctgagcatttttgataaatgtacataataccatacatgtagtatttgcatttaagcctattcagtgcatgcactgtctggaagagctctgactaaatagacacgtgcaaattttttccccattcagtgaacactattaaaaaatcagatgaatatttatacagtggcattggccatgcaattcttcctgctttgtccctttatcacacactaacagaacgtaggattaattatccacctaattaacttgggggtggggtagagttgctggataaagtacaagacactcagttcaattccaatttcagataaacatactaaaaatgtattcattgtttatctgaaattggaattgaactgggcatcctttatttttagttgctaaatctggcaaccctaggtggggaagaggcaggagactagtagatataggcacagttgtgagatttaaatacaccatgcaatgacaagagtaacctttactctcacgggaatactaagtgttttttagcgcaatgctatttattttagtgtccaatgcttttttctttttttttgaaaatgcatca

SEQ ID NO: 138674 - DNA, 1011 bp, Homo sapiens
gggaaaggtttgcatgacatcacagggcagctagaggggagaagtgttgggagactggaaaggcctctgtgtgatgccactaatcatatgaagtagcaatccacatactcttccttttttttttttttttttttttggagacagaatcttgctctgtcacccaggctggagtgcagcggtggatctcggctcactgcaacctctgcctcccgggttcaagcgacactcctgcctcaccctcctgagtagctgggactacgggtgtgcaccaccacacctggctaattttttttttctttttgtatttttagtagagatgggatttcgccacattggccaggctggtctcaaactcctgacctcagacaatccacccaccttggcctcccaaagtgctgggattacaggcatgagccaccatgcctggccaaaaataatttctataattaaaatgctaaatgaatagggactggagaaagcatgtaataaactattttatattcagacatgagctttgttaatataaactaaatgttagctagtgtactagtgtatgaaaataactttcttttttattttattttattttttgagacagagtctcactctttcacccaggcgggagtgcagtggccctatctcggctcactgcaagctccgcctcccgggttcacgccattctcctgcctcagcctcccgactagctgggactataggcacccgccaccatgcccggctaattttttgtgtttttggtagagacggggtttcactgtgttagccagggtggtctcgatctcctgacctcgtgatccgcccgcctcggcctcccaaagtgctgggattacaggtgtgagccaccacgcccggcctttttttttttttttttgaaatggagtcttgctctgtcacccaggctggagtgcagtggcgggatctcggctcactgcaagctccgcctcccaggttcacgccattctcctgctcagcctcccgagtagctggggctac

SEQ ID NO: 138675 - DNA, 1016 bp, Homo sapiens
agactggtcttctccactttttttttctttttctttttgagatggagtctcgctctgtcaccagggctggggtgcagtggcatgatctcggctcactgaaacctccgcctcccggttcaagtgattctcctgcctcagcctctcaagtagctgggattataggcacgcaccaccacaccctgctaatttttgtattttctgtggaggtggggtttcgccatattcaggctgatcttgaactcctgacctcaggtgatccgcctgcctcagcctcccaaagtgctgggattacaggcgtgagccactgcgcccagcctctcttccactttttgttttccacattttctacgtgcacacaagacttttcagtcacaaaatatatacacattttttaaatgtggacttgtctgtagtaagtgtatagaagtatttgtcttctcatctcctctattcaacacctccttacttttatttctgaacaggtctccaggaaaagttgggctttcaacattcaaggtaagttgtgctttctgaaagttatgtttttagaaattgtatactttttattcgtgtttttgtgtaattcttcattttcttgcttttgcttttttttacttactttttgctcagtaatgtagtcattatgtcctacttggtatacataggtactctagaaatacctaactaaatattatgctgtaaagaaggaactgtaagtattttttagatttctactgatttttatttgtttataatatctagaataaaagaacgtgtgtgtgtgtgtgtgtgtgtgtgttgaaaaagtgatacttggccaggcatggtggctcacacctgtaatctcaacacattggggggctgaggtgggcagatcagttgaggtcaggagtttgacaccagcctggccaacatggtgaaaccccgtctctactaaaaaaaaaaaaacacacaaaaattatccaggtgtggtggcgcagacctgtattcccagctacttgggagactgaggcagg

SEQ ID NO: 138676 - DNA, 1050 bp, Homo sapiens
gaggcgattactgtttatgcttataggtcttaaaagccatttagcgctaagatatttttatattataacaaatagatttggagaatttactttaccccgtaattatagattgtccttaacttgagtgaaattagataacaagtatacatatttagtaaataaatatgaagttggatattgttcatttttttaactttttattttgaaataattatagattcacaggaagctttaaagataatgcagaaaggtcctgtatattcttcaccatttccccagtggttatatcttaattatagtacaattttaaaatgaggaatttaacgttggtgcaatgcgagtgtatagttctgcgccaatttatcatgtgtatatttgtataaccaccacaatgaagatgcagaactatttcatcatcacaaagatctccgttgtgctacccctttataatcacacccaccaccttccccatatcatccctaaatctgttttccatctctataattttgtcacttaaggaatgttctataaatggaattatatactatgtgaccttatgggattggttgaaagggtcacgatccatccaagttgttgtctgtatcaatggtttgtttctttttattgctgagtagtattatatgataaacatgtactgaggctattgagtgcatattatgaataacagtatatctattgatattgtaatataaaggaaggcttgatatagttctgattgttggtgattttacagtctgatggaagagacatgtatacaaaagggcaatttatgaggtctcgatgtttgtaaaatagaatagacgtgttaactgccacaaggggtttggaggaacgagaggaagatagaattggcgtgagagcactgttacctgaaatagcagagaaaagtttcagggaggaaatagaacttttgctgagctttgaaaattgggagaggtttgcataggtagatagagaaaaattgggaaagcattgtagttaggaaatagtagggactaataaatatgcaaaagcatgggatttgctaga

SEQ ID NO: 138677 - DNA, 1024 bp, Homo sapiens
ctggtggaagggtggaagaaagtttggaggaaaaagacttaggtgcaaagaaagctgtcaagaggcagttaaaatgtcaagacatgagactccaacaaagggaacagcattgaaaggagtggatgtatggatatgacagcgatttaagagttgtttactttttagaacaattttctcagcaaaaaaagagtggaagtcacatttataagtttttctccttttttaaaaaatttcactttagtagcttcccttcccttactactaaaaattaccagttacctgaatttttctataattaatgtttttagcttaatgttctttagtaggtaataatgaagatttctgtgagtgtagatcactttcatacaaatactttgttgggtgtacttattaaaattaaaaagctgaaatcttataaccaaatactgcaggggggttatagacagctctgtaatatccaacacaggtggaggtaactgttacatgaattgctgaaaattgaataagctaccataccttttaaggaagcaaatttttgataccatgatagataggagttagagaaattgcctaatagtagggaagctgggatttagtaagtactgcattttaataatgggtcagcacatcaccagaagtaggtaatggactgtctcaagtatagctaagttggcattggttgtctgtggacacatgcttggcttccattcctttgtcccaaaagcctgatcaaggtgttagaaggacctggatgttatacatcactgagagagaatcataattgactatatatcctaagtctgattttattaagaagtcttctctggagatcaggccctctggtaggtgccatatcactcctttaaacttgtgacttaaaacagcagagtaccttaggagttactatcttttaaaagttcagactccaagagagttttgttaaagccaaataaaatagaagtctgatcactgcttggcagttttggctagtgtaggaatgttaatcttttataagtaaataatt

SEQ ID NO: 138678 - DNA, 1028 bp, Homo sapiens
tgtcccatttggcataaaatttctgagcatctatcagtattcagaaatctaagccctttaggctgggcacagtggctcacacctataatcccagcactttgggaggctgaggtgggtagatcacttgaggtcaggagttcaagaccagcctggccaacaaggtgaaactctgtctgtactaaaattacaaaaattagccaggtgtggtggcacgcgcctataatcccagctactcgggaggctgaggcaggagaatcacttgaacccgggaagcagaggttgcagtgagccaggattgtgccactgcactccagcctgggtgacagagtaaaactctgtctcaaaaaaaaaaaaaaaaaaaaaagaagaagaagaaatcaaagccctttaagggcctttgatttattaatgctacattttctcatttgtacccctttaaagcatatttttaaagaaaagatgtcatcatttggtctctatttcttttctttttcaaacaggaaacagagaacactgcatacaaagttggaaatgagtcccctgtacaagaattgaaacaagatgtgtctaaaaaggttggaaagatacaatgtcaatattagtttatagcagacatcatatttatatggtatatttcaaacagcttttatattcttttagtatagcgctctgtacatggctgatgttcagcaaatgtttcatgaatctgtcacatttgtggttgaagacatttcagtctttttagaagtccttttcatattctaattggtaatttatccttgagacaatattttgtaaaatgcttttattttttgttcttgtatttttatcagaataagccctaactcttcttgaggttactaccaggagttatgggtattgaaaagctcagtgcagcaacattctgatgtctttaggaatcagaagttataagaagtccttactctgatagtacctgataccttttaaaaaattgatgctatgaagcttcaaaggttggtttactagaagagactgagcacaagatc

SEQ ID NO: 138679 - DNA, 1413 bp, Homo sapiens
atttttattgttgaaacttaaaatattcctgttttttccactatagcttttcttattttttaaagaatgtttttcttaggataaataacaaatgtataactatctatagttagtggggaaaaaagatgattttaaggagagtttagaagtttaaacagtagtgagaaaacactgtggagcagaatgaggtttaagattctaaataatcactttttaagttctagccttttcagttgaattaagtatgaatcactaatgataaaggctatggggatataccctggacgagggcatactctgctctcgagtaacttacattttagtagaagaaattggataaacacaaaactaaatgcagtaagtattcaaataaacttagaagctattgtaagaacacaaagggaaggagacttcttgcttgggggtaggaatgaagatgacttcatggaggaggtagcatctgagctggttcttaatgaatgcataagatttggacaggctaggccgggcacggtggctcacgcctataatcccagcactttgggaggccgaggcaggcggatcacctgaggtcgggagttcgagaccagcctgaccaacatggagaaaccccatctctactaaaaatacaaaaattagctgggcgtggtggcgtgtccctgtagtcccagctacttgggaggccaaggcaggagaatcgcttgaacctggaggcagaggttgcagtgagctgaaattgcgccactgcactccagcctggtgacagagctagactccctctcaaaaaaaaaaaaaaaaaaaaggatttggccaggctaagatgggagaggaaaggcattactgaaggcatggaggtggggaatgtgcagaacatttgaggatgagcctagagagcaaagttagggctggattataggaatgccttatgtcatactaaactgtctgctttttatttatttatttatttattttttgagacttgagtctcgctctgttgcccaggctagagtgcagtggtgtgatctcagctcactgcaacctccacctcctgggttgaagcaattcttctgcctcagcctcccaagtagctgggtttacaccaacacaccaccacgccaggctaattttttatatttatttatttatttatttattttgtatttttagtagagatggggtttcaccatgttggccaggctggttttgaactcctgacctcagttgatccgcccacctcagcctcccaaagtgctgggattacaagcataagtcaccgtgtccggtcacagtgagctttttgcagcaaacaatgctttagcataatcatctctatgtgtgtcttggttctcattgttctcttagtctttccgttttcactatttcctaaaatccagaaaaaaatgacagggctag

SEQ ID NO: 138680 - DNA, 2578 bp, Homo sapiens
tgaggcaggagaattgcttgaacctgggaggcagaggttgcagtgagccaagatcgtgccactgcactccagcctgggtgacagagtgagactccatttcaaaaaagaaaaagaaaggaagggaaaagacaaggtggactgggtatttgaactcttttcatggtcctgccatcagtccacatagtggagtttaggtgtagtctgtttaagaatgttaatctccctgcatctgctggtttttgggtcataagcttgagttcagagctaaacaacttgaattcttctcctggggatttggattatcgtggtttggttaagtaggctcaaaccattaggctggtattacaacaagtttggcataaatatgtaaatgaatcaggatattgagtcttaatgtaagtttaggattgaacttgattttacaggattatttgatcttttgtacctaagtattaacacaaatttgctattatgagggttaagagtatagatgctggaatcaaactccctgggtttatacctgcttcatcacttactagctttgtgaccttggacaaatcatttgattagttccctaatttgtaaaatggtgacagtaggagtagaatctcataaggttgttgtaaagattaaaatatgtaaagtgttaagaacattgcctggcacatactaagtactatgtaaatgattagctgttactgtgttcttataaatagcttcatttttaaaaactacttttaaccctttcatcagattattgaaagtattattgaggagagtcagaaagtactacagcttgaagatgactctttggattccaaaggaaaagaactctctgatcaagctactgccagtcctattgtggctagaacagatctgagcaatatacccggactgttagccatagatcaagtactaccggaagaatcccaaaaggcagagagtcagaatacatttgaagagactgaattagaattaaaaaaatgctttccttctgatgaaacctgtgagaaaccagtagatgaaaccacgaagttaactcaaacaagttcaactgagcagcttaatgtgcttgaaactgaaacagaagtattgaacaaggaagcagtggaagtcaaaggaggtggtgatgttttagagcctgtgtcctcagactccttatctactaaagattttgccgctgtggaagaagtggcccctgccaaacccccaagacaccttactccagagcctgatatagtggctagtacaaagaagcctgttccagcacgcccacctcctccaactaatttcccacctcctagacccccacctccttctcgacctgctccaccaccaagaaaaaggaaaagcgaattggaatttgagactctgaaaactcctgatatagatggcaagtattaattgagaaatcactctgttggttgggcacagtggctcacgcctgtaatcccagcactttgggaggccaaggcgggcggatcgcttgagctcagttcaagaccagcctgggcaacatggcaaaaccccatctgagcaacaacaacaaaaaaaaatacaaaagttagctggccatggtggcacgcgcctgtagtcccagctacttgggaggctgaggcaggagagttgcttgggcctgggaggcagagactgcagtgagccaaggtcgcgccattgcactccagcctgggtgatcagagtgaaatcttgtctcaaaaaaaaaaaaaaagagagaaataactctttgtggtgaaattttggagttgaaactgtttacctttctgcctttatttcactttattaaaaaactcactggcaaccaagttattaaaattatttctttagtaatagacaaaatgtaaaaatgtttacattggtgaaaattactttactgtaattgaacacttcagcagacttcaaactttcaattctgttgccatctgagagagagtggcatggtgaaaaaaacttgggatttggagacctaaagtctgaattcaagtcctgcatcttttttttgtatgagctgtatagtcttgaggaaattaaataacttgtttgaaccatggtttccctgtataggaaatgagagtaatcaagccactttcctcacagggttgttacaagaatcaaacaaaaagggttgttattattgttgttattattatcattgcagttcccaaagagaatattacgtctgattctctcctaaccgcaagcatggcttcagaaagtacggttaaggattctcagccttctcttgatttggcaagtgctaccagtggagataaaatagttaccgcccaggttggtgaattagtgttctgtttcatatagactttatcagctccctgcaactggctggtttgttgatgattattctgtattctccaggccagatttttctttgtcctccaaacctgacccccttacttctcttgatcagctctgctacatgctaactgggtgagcctagcaagctgtttagcatctggatctcagatgccccatcaataaaatggaggaaaagtccttccttgagggtttgaaatgagctaaaatatgccaagtatctagc

SEQ ID NO: 138681 - DNA, 1050 bp, Homo sapiens
gtcaggtccatcatttaaattaaaattatatgggccgagcacagtggctcacacccgtaattctagcactttaggaggccaaggtgggtggattgcctgagctcaggagttcgacacgagcctgggcaacatggtgaaaccctgtctctactaaaatacaaaaaattagccagacatggtggtgtgcgcctatagtcccaagtactcaggaggctgaggcaggagaattgcttgaaccagggaggcggaggttgcagtgagccaagattgtgccactgcactgcagcttgggcgacagagcaagactccatctcctaaataaataaataaataattaaaattatgtaaagcttattagcgtagtttttcttattctgattaactggttatatagtaagtataaacagatttttaagaagtatagaagaaatggcttcttttaaaacaacttccccttcttacagtaatgacgcggcacagtcagatgatgaagagaagttacagtctcagccaacagatactgatggtggaaggttaaaacagaaaacgtgagttacagtacatcccttttcttcatttcaagtttttatttaaaaaaatatgagaactaccatactattttaaatcatgctccatgtagtttttatgtctacccaccaccattcctccctgtccctcgctgatgggttatgaagttgtattgattagttttaaagcatctgggctgggcgcaatggctcacgcctataatcccatcactttgggaggccaaggcaggcagatctcctgagatcaggggttcaagaccagcctggccaacatggtgaaaccccatctctactaaaaatacaaaaattagttgggcatgatgacaggtgcctgtaatcccagctacttgggaggctgaggcaggagaatcacttgaacccaggaggtggactccactgcactccagcctgggcgacagagcaagactccccctcaaaaaaaaaatggtaataataataaagcatctgacatacagaaaatgaccagtaagtgttgcaccat

SEQ ID NO: 138682 - DNA, 1024 bp, Homo sapiens
ctgtccctcatgagctcccatgaatcagtaaaaatttactcctgatttgtatttcttttggttttaaatatcatcatgtactgtgcattgctttttgtaatcttaatatatgaaatctgagacttagctaattgaaaatgcaataagtaagtcctatttatggaagcttgagatgcatacttagtttacctcgtatttgggaatacctactaggaaaactcagcctaattttattacatgcacctacccaaactgaaagagaagggacaagggaccatcttaagctaccaaagcattctattttgtgaggaaatatctctttactctttattggtaaaatgtgtttttaagaacagctctctaaagcagccttctcaaagcagttctcacccccagactctctaaattggattatctggggatggagctgaagtacctacactttaaacactcccctctccacactacctctgccaatcaatttttattcaccattgaaaaccaaagctctagaatatatgaatattgtaaattgggggaaagggtgtatgtttcctttgccatattgacttgaatatgtttattccatagaataagggatttggaactcaaacacctattatttatgtttaaaaaagttatttcaaagtagtgtactttatcagtcacagctgatacatttgtctgcaaattattggacttttacagttaactgagttgatacttttttcatttttgttaaggactcaactaaagaagtttcttggaaaatcagtaaagagagcaaagcaccttgctgaggaatatggtgaacgtgctataaataaagttaaaagtgttagagatgaaggtgagttaaaacagaacatttcaactaaacattcaattaatttgtaatcgtctaaatttagcctgtagtttgtaagaagcattctatttaaaatagtaaacctttatagctgacatcttagtatttcaataaataaggtactctatgacttaattttatgagtgtgaagaaaaa

SEQ ID NO: 138683 - DNA, 1042 bp, Homo sapiens
actgaagcctctgcctcctgggctcaagcagtcctccctcctcagcctcctgagtagctgggaccacaggtgcgcaccaccatgcctggctaattttttgtattttttgtagagatggggtttcgccatgttgcccaggctagtctcaaactcctgagctcaagtgatccacccgcctggacctcccaaagtgctgggattacaggcgcgtgccaccacgcccggcccattccaaaactgtaatacttctaagtgctggatgctatacgggtcactgccaaggtgggctttagtcttcctcagtcctgctcagttgttagtgctatgctgagggctctgccacccatctttacgttcagctaggggactaagatccccagctaggatttgtgcttttccaatgaagatttctgaccactttagaactcccatttctgttaatatgtggacagggtttgagttcttgaagttgttagtttagattatggaacactacaactatcttaccctacctttcttgtgaaagtctacttttgtggtattatagcaccattgaacttttggacttaagtagtgttagcaatttgagcattatcttagtatatgtaatttggcgtaattttaaactttggctttaaagtaatgtctctattttattttatttattattatttttagatagagtttcgcttttgttgcccaggctggagtgcaatggcgcggtcttgactcactgcacccttcacctcccaggttcaagtgatcctcctgcctcagcctcctaagtggctgggattacaggcgcccgccaccatgcccagctaatttttgtatttttagcagagatggggttttaccatgttggccaggctggtctcgaactcctgaccttaggtgatccacctgcctcagcctcccaaagtgctgagattacagacgtgagccaccatgccaggccaaaagtaaagtctctaaaggtgtaaagtattaactttgaaacttcttttgttttcatagggagctgtttggaccatgaaatttt

SEQ ID NO: 138684 - DNA, 1044 bp, Homo sapiens
ttattcctttccaggtgtagtgtgtagttaatttcatcaactattgagaacatgatatttggtttcctctggcaaccttcagttctatcctaggttaaaatagaattgctaattaaactggaaaaagaatgaaaatcatatatatccagtaagtaaaaatgattaaggaaaaagtcatggaaaatgaatgtgaattgtcaatatatcaagggatatatgaaaaaatgttgaaaagagaagcctcagaacattatgtacacactgattacaactatgtacagatatttatgtatcatggtgttatcaggaaagtatgtagaactgatgtaaatttgggctttaagttcatgggattcttttctaataactatttaactgtgtaataagttttttccacaccctccccgccatcaagtaaggctgcaaacgagaagtaaagcataggagaaaggagaagaaaggtggccatgggtgagagtatatagtcaaagcaccaatttgaggaacataaaagtctagggagattcactaaactggcaagctagacctcatatacttgagtaaatcctgtgagtattgcttgcattatgtttcagtacttagttgaagatgataataatttgacaagaagttaaactgtgtttactatatggtgagtttttctagtcctagctgtgtgtcatttcttttactgccctgccaagagcaaaaagactattttcagtggcccttgagactaaccccagccctgaacctttctgctcctttattgttcctcttgctacttgtcatgattaataagaatgtgttctattcgaatactgaggatttaacggtattttgtttactaaagtagggaaatggttaagccattttatgaagtttttatgtaaaaatgattgaaacaaatattttggctcctatagggttatgcctcaattgttagtatttttctagaatactgtattctctaactattagacattgctgtgtcattacttctggatgttatattttggtgggtctgtgtgtgtacatacatgc

SEQ ID NO: 138685 - DNA, 1043 bp, Homo sapiens
aactcctgacctcaagtgatcctcccacctcggccccccaaagtgctgggattacaggcgtgagccaccatgcccagccttgcggtttaaaatcttttgacggccctttatctcccccacaataagattcttccctgtattgcctaatcttaacttttgactcagttccaattccctagtgcctgtgcatcctaccagccgtgcctgatacaggtctgtacactataaacactttcactttcatgtctctgtccctgctgtttgctttgccttcacagggcaaagccctacttatccttcaagattcagctcaaatatcttattattttccctgaatccagcagataaaattgttcttcatttgtattctaatagtacatcataggtacttttatactgatattaccatgtctttcttgttagtctccctggctaggctctgggctgattgaaggcaaagaactgtacttcacagattttagtatccttggaatctaattccattcctgactgtagcaggcccataatcatgttgaattcctgcctgtggaccttattcctattgttccccttatttggatgccttgatcatctttctattcaaagcatgcccattcttcatggcccgcttcctccataaagcctcactgactaatgtagcagagataattttaactgctttgctttagggaaaagggcttgcttttattagtttaatttaccatacagtttccaggcattgattactattaaaaatagagactatctgtagtatcttttattgcgcttatttcagcaatcctacttatagatcctcagctacatccatctaaccccaaacagacctaagtaactcacaattttattgaatacaaagcctttttacatgagaaataacatttatatccattgttttcaggaagagatcatttggggtttgtttcccttctgtcattttatttggggacagttaaaagaggcttctatttcacatgccattagagtttgacaccagaaattatcttctaacctagtgctagcca

SEQ ID NO: 138686 - DNA, 1050 bp, Homo sapiens
gccccaagagactgtaatatcctcaagccagggaaagaccagctaagacaaggtaagtgaaagtgagcctcagagcagaggagagattcagcagaatgaaagaattacaggagccagccagaaaaggagactgaaaaggtggggagatgatcttctcccctgaagctggagggtcatgggcatgtgataattgtggcagcaggcttcatattcctttaaaaatcaacttaaaactattttttatacttttaaggtattatgaagacagataacacagaagttcttctctctgctgacttcactggagcaatcaaagtgtttgttaataaaagaaaaaatgtatcttaatttgaaatggcatttaaaataaacatatcagtaagtttctatatgtatcaaaactgaaaaaatagtgttccaggctaacatacttttttaatttttattgaaagttgttcaaatataatatattttttgagaggcagtgttaatgatctaggaaaccctgggctgatagagtagaaaggaatatggctagaataacattgccaaacattaggctttatgttttgttatgtttgtgttttcgttgtataattatgaacatgcacaagtttctgcatgaaaagatattaatatattaatcacatgtatgtgccttttggttacatgcattaaatctaacagagttaaattatttcagtggctcttttggcctcttactaggggggatagtcttgtttctagcttaaacaattttttttttgcacaaaatttcatttttaataaaagtggtatcttttgactgagttattgttttgaaaatggtatataggtttccagtaggtcaacaaccatatgtaaatggtttttataaatttctcaatttggggacaagatttttttgtggtctaaattgtgggcttaagattcttttctttatatgtgtacatataatttttttttctttgccacactggagcacaatgtttctatgtaaagaattattttcattctttatccatgagcaccaggctttgctcacttaaa

SEQ ID NO: 138687 - DNA, 1106 bp, Homo sapiens
cccggcacggcggaggcgtgcgccgggatggaagcagacgggcaaaagccgggctcggacggctgcggaggaggcggaggcggaggctcccacccagggtcggggccgggggtgtgagctaaagagctgacctcgcgctgctctggactcggcacaaagagccggggacaagggcacgacgagatcctgatcccctcccgcgagcacctgaggccgcctaggcggaaggatgcgatgagcgtttggcacacacactctcgcgcgcacacatacacacactgtgtacacaaaaaagaaccccacccagaaagccccgggcgcccaagctcgggctggcggtgagaacagaggaagcagagcgacttcctcctgcaactggggagagagggtggtgatgggtgttgaaggggtgctgctgcggaggaagggcattagaaacaacggggttctgcgacagagtgggcgcagggtcatccaccgcagggagagtgtgtccctcggggacacgcgagcgctccagaggcaaggggaccaaggggacggtgccgtggggatttgggggaagactgggtgtgtcagtccagggatggaggacctggggtcagagccccacagctcaggactgggggatggggattcgaaagcgcgctgactccctgggaaccctcccagagcaccctcagccttatccagattgtctgactctggagaaaggctaaagggtgctaacgggcacttgccccttctcttgttttcaagacactcgttgccagtttcctggacaagcgaacaaaccctgaataagcaatcggactgattaattagtgtttgttttgttactttgttttttggttgttgtttttgtttgtttttgtctccctcagctccattttacagcgagtcgtttgctgtgtttaaatttcaccgtttaagagagggctctttttgttaaaacaacttgtcatcggaagggaacttcacagcttttccttgtaatttttctgttgatcttgtagaatcagcaataaaacccagcattaaagggaggccaggggcttgatcccaacagtggagaaagttgacattagtgggagttctggaggagg

SEQ ID NO: 138688 - DNA, 1020 bp, Homo sapiens
gccaatagctctcgttgtgtccagccgagtgtttacgacatgctctatagtttgtggagcaaagaaagccctcccttgctaacttgaccctggggagacttgctcctctactcctagtgaccgacatgaccacttgcaagggaacttggcctccgtctgtccctgctaaatggtctggcagaattctcatcaggagagccagaagaaaattccataaggcttctcgcttcagttctgtaataacaaacccagctccctctccctgcctgccctgcttcctttgctcagtactgcccctaggctcagagacatcagggagtctcatattcagagcccaggttcttcaagtccataggctgctggttctgccctgcctttaaaatccatttccagtcaactggatttggatcttcttgtccccttgtgtctttgtctcactcactgtatctctgtctggccccctagcctgtccatagctaaccccctgcctcagttttctggctaatcgcccagttcctctaggagtaagttcttgccttgttgctggccttcctgaggaggggtgccttaccctcaccaggaccatatgactgagcccagcacagtggaactgtggattgaaggggtgagtttctctctttttttttttctggaaacagagtcttcccaggctggggtgcagtggtgcaatctcggctcactgaaacctctgcttcccgtgttcaagtgattctcctgcctcagcctcctgagtagctgggactacaggtgtacaccaccactcctggctaattttttgtatgtttagtagagacggggttttaccatgttggtcaggctggtctcgaactcctgacctcaagtgttccaactgcctcggcctcccaaagtgctcggattataggcgtgagccactgcacctggcctggaggggtgagtttctgcttagagaactcagaggagacaaagtgcctgggataacgcagtccagcaagtggccctgttgaggactggactagc

SEQ ID NO: 138689 - DNA, 1042 bp, Homo sapiens
gggagcagcagcatcattccagttgttaccaggtgcagttgagtaggcctactccaccttcatgtttcttgccccctcttggagaaataatgatatggtttggctgtgtacccacccaaaaatctcatcttgaattgtaatccccataatccccacgtcaatggtgggaacaagtggaggtaattggatcatgggggcagtttttctgcatgctgttctggtgatagtgaatgagtctcatgcatatctgatggttttttaaacgtctgacctttcccctgcctgcactcactccatcctgccaccctgtgaagagggtgcctgcttctcctttgccttctgcctggactgtaagtttcctgaggccccccccatcaatgctgaactgtgagtcaattaaacctctttcctttataaattacccagtctcaggcagttctttattaggagtatgaaaatggactaatacaaataatttggccagagttttgtgcacacgttcctgcggggtgaaacaagtcagagttgaccaccttgatggtaagcaaaaagttattgtcttgaaatatctagaaactgtaccattctcctacctcttgagagcgtgggggagattaacaatacccaaacccataaaaatgccaactctgtctgcactggcttcacattgccataaacacccagatttcctagaggggacttcatggcccttcatgtccaccagtaaggaccatcccacctttgaagtttcttctcccaccacacccttcctttgccctgtagtctagccacattgaaccatcacactttttcaaacacatttctatagtttctcacctacatacctttgtgcatgctgactcctcatccggggatgcccttacaagcccttccctgctaaagggaatcctatctgtccttcagggcttaggtcaaatggccatcttctccatggccaccatatttggagctaattgctccttctgcagccttacagcctcttactagttgcgttggcttcctgtggctgctgtaacaaatt

SEQ ID NO: 138690 - DNA, 1121 bp, Homo sapiens
atcattgtggaggcatctgattcagggcacagccctgacatcggactatgcaaattgattgggacaccattgttatcgtaagagagaggaatttttccattcacgaagcctcaagtgtactgttcttctataggctgaggcatagggagctgccaaggtggaagtcaaaaccttgaggggcaggcctgagagcccagttgatcccagggcttgtatctatgtgaatgaagccgccccacccctggcacccagttgggattttctccagcagcagctgcaaaggctggaagccccttggagaagcagcagagaaataaatgagaaggggatttgatccagggctggggagtggcggcggatggcggatgtggttcaaaatgacaaggggtggtgggggaagaggtcccagttgaactgaaaatgaaagcaagacaggaacgcactgtcacattgagaggatagcattttagctggagaatgtacaggagaaggtgtagacatagttttgtctgtgtcagacaccttgatagcaaacactataggtagaggcttctggaggcaggattgctcttagtctaaggtcttatggtaacatttgcaggggatacgggttagcattacaaaatggggatgcttcaggaagggcgtgggcgagtgcttcttgctattacttcttgtaaccaaagctagtctaggcttttgggtatgttcaacactgcatggcctttggagcacttttatgggaagaggtaagaaaatgttcctgtgggcacatttagcacacagactaaatgtgagcttcaaggaagggagggtgggtgggatagacagagagagagaggttgtttaggaggaagtttgacaaggggaaagctattaccagcacaaatggagttttgcttgagtcatcgacttcttctcaggtttaattcaagtgcgcaaccaatactgtttactttttcttttttttcttttttttttttgagatggagtctcgctctgtcacccagactggagtatagtggcgcgatctcggctcactgcaacctccgcctcctgggttcaggcaattccgtctcagcctcccaagtagctgggactacaggcgcgtgccaccatgc

SEQ ID NO: 138691 - DNA, 1571 bp, Homo sapiens
ggtcatatttaaattttttaaagtgctgactttgaaaatccttaaatattcaaggaaaagtttgaacggagtggaaattctaaaatgtttgcttacttttatggtggtactttgattttctgaatgtgaaggatgccaaaaggccttaaatgataatacttaacaagtattgttttctcccaactttatacatattcatactactgtgctcagtcctgagggaggggaacaaaaaatatatttaacatggtcatttgttgtcttagagtgtctgtttcttactgaaagaagcagttatttcatgaaagtcttgacgcacatatgcactaagctgagataaaaataaatataaactaatgaaatctaatagtaaaaggacaactaaactaactgaacacatactttttctcccctctagtgccccaaaatgcgccgtcatgcttttgaactcaagatgttagataaatatagccattatctggctgctgaaactgagcaggaaatggaggaatggttgataactttgaaaaagattattcagatcaacaccgacagtttagttcaagaaaaaaaggagacggtagaaacagcacaaggtcagaattttaaagtgatttattattgaagtaaagcccttgtctttaatccgtggaaatgtcctctgtgcagggtgagtagagaactcttaatcttaaaagttgacctgcttcttcattaataagtgactgtggaggttgatagactttttttaaacagttgatgctgcatgggctctgacatatgaaatataaccagactaaaacagatagaaaattcatggcaggttttcaaaagtccattaaagttttccctatgctttcataatagaaattctttgcaataaatcttgtaggagaggatgggtgggagagatagttaggatactcctcttaggttattagtaatggtctgtatggtttagaacatctgcttttaatgaatttgcagatgatgaaactagcagccaaggaaaagccgagaacatcatggcaagtttggaaaggagcatgcatccggaactgatgaaggtacatctttcatatggcaacttgccttcaactgagataatgcaggattagctattaaagttttaatgctggattccatttggcaatgtcatttccacgttaaaaaccacagcaaattggtgaaacaggtagagattgtaaaagaaaagttgcactcctgaagactaacttgtaagtaccaactgacagtttggaaaaatcttatttttttccagacaccaagaaatacttccaggcttttgtgacttcattaattttatctgctagttcttatttaatttaattactgtatatcattcataaaatattcttcttccaaaaggataatgatgcagctcatgcacatgatatttaatctatgaccaacatatgttaatctcacatgaaaatcatattctctatatgtaaatatatgtgtatatgaatgatttaatctgataaagattttggtgaacatgcatcatttttgttatttactctgctgtttgaagtttgaaatgaacc

SEQ ID NO: 138692 - DNA, 1089 bp, Homo sapiens
ttacaggcgcccaccaccacgcccagctaatctttgtatttttagtagagacagggtttcaccttgttggccaggctggtcttgaactcctggcctcgagtgatccacccacttcggcctcccaaagtgctgggattaccagcatgaaccactgtgcctggccttatcttataaaatgattttatagattttagttgcattccctctcaatctttgtcatcctggattgtgcagctccattaggtatttcccaaagtgatggaatcagaattacatataatattctatagctaacataatggctatgaaaactatggtgatttctcttttgtttatttctcctttgcatccagagtctcttgcattcctgttttgtactgactacaggatgaatggtatatttttgaagctgtgacagattgatagtttcacataaactatacatttaaatagtatttaacactgttttgaaggaaatgaagtaacatacttattttttaaaattttagtatggaagagaaactgaacaactaaacaaactcagtagaggagatggaagacagaatctcttttcttttgattcagaagttcaggtattaatgatacatttctttaatagtcctagaattattgcttattcagataaacaacatctttgaaatgttgaaatcactgtttttcttgcaccagtggggaatatagattgttttatatttgtcttgtttgctttgaacaggtaacttaacaaataactcttcactcaaggggactgtcacatatgcagataatttggggctgaattatatatatatatatatatatatatatatatatatatatatatatatatatatatttctcagtttcttgtattcttttcacttccttttgctcctcaaaatagataaattaaagcaccgttaaagatggttacagtgttcttttagcccatgaaatacaattgtgatctagtggcagaaaatatctccagtataaagaacatatgagtcatatgagacatttatttttcacatttgatgtaggcctgtagaactaggataattgtcatgtctggcttaatcacacttt

SEQ ID NO: 138693 - DNA, 1045 bp, Homo sapiens
gccataatataattttagctaagtgttgaactcagaaaggaattgtaatcacagaaactggaggaatacaaaacttattttgcacttgtgcccctccccgccatgcccccactaaagtctcagttttaaaatgtaactgttttcattcccaggttgagcccttttttatcaatcttgccttatttgatgtaaagaacaattgtaagatttcagcagactttcatgtagacctgaatcccccatctgtccgtgaaatgctgtggggctcttcaacccaactggccagtgacggtagcccaaagggctcttcacccgaatcttacattcatggaattgccgaatctcagttacgctacatacaacaggtaacgaatgacctttagtcttagcagcgtattcagaataagaaacagaaatattcttgtattatttcatggtttcaggccaatgttttcatggcattctctctcttgtaaggtctgtcgatagagatttttctggttactgaagtttgagggcaaaaatggaaaccaatgaacatgctagtaacatgttatcaaaggaacatttttaatgggaccatgatgtgagacacaagggaattattttgtgagatagaaagctgaaccaggccaggcgtggtggctcacgcctgtaatcccagcactatgggaggctgaggcgggcagatcacttgaggtcaagagttcgagaccagcctggccaacatggtgaaaccccatctctactaaaggtaccaaaaaaattagccaggcgtggtgatgtgcgcctgtaatcctagctactcgggacactgaggcaggagaatcgcttgaacccaggaggtggaggttgcagtgagccgagatcacgctacactgcactccagcctgggcaacagagcaagactccgtctcacaaagaaagctgatacagacacccataaacacacctgcacccacactcatacatatacttctaagcaaggcaataagtgcttgaaagttttggtttttaagaaaaattgaccctaaattaactctcc

SEQ ID NO: 138694 - DNA, 1180 bp, Homo sapiens
ggccatagaccttgtcctaaacggccagacctccagcccacgtgggatttctgggttctctctggccaccttttgcattctggggacagggagaggaccagaagctgttgggacaaaaggtaaaacaaccccaaagagtgtcccccatcattggaatccctggtcagttagaaaatggacatctctgtgcctcagcatccttatctgcaagtggaggtggtgacagtacctgtctccaagggctgtggggaggcacaaataaggtgcgtggttctaagaaaacactcagcactgtgatgggcacactgggttagcgcagtgcagcgtagcagccaggagtagtagcactgacagtgatctcaaacaagtgaaaacagcaagcttttatcaattatcaactatcttaaaattatagtcctcattgctggcatcagtaggaaatgcttagagtactgggaatgggaaacaataggtgctcagtaaatgttagctatagcaataatcagtattactgttctcaaactcctgggctcaagcaatcctcccgcctcagcctcccaaagtgctgggattacaggcacgagccaccacacccagcagtattactgttctaatcaggcctcatcatatgagatgttgggtgtatgggactcagggctgagagagaatatagcatgggctgtgtaatctggaagcctgaactgcaatcttcttcacccacttactcactgcacaaacctttctgagcctccacttcttaatctatagaatatgtatatagtagtgcctacatttcagggtttttatgaagactgaatgagataaagcatgaaaaccatctagcatggttatgtggcagttagcgtaacactgcactcaaggtgcactgctcagcataccttctgcagggacagcccgggcagtctgccaacccgttcagcctcacagctcaaacagcatgttcccggcagtacccgaagccaggttctgtgaccttgggatgctttggtgggccacctgggtaatagcaaggtacctgatgtgcattacttcatttaatccatacaagaaatgtatgaaatcactactatcctgctatttcacagatgagaaacctgagacttagagagaatgtgacttgcttaaacccataaatgttggagccagaacccaagaaatt

SEQ ID NO: 138695 - DNA, 1035 bp, Homo sapiens
tttccttcttagtggaaataaatattagttaaatattaattgctcttgagttacatgcagctgcatttaaaaatgtatatctagttccactcgagaaatgtactcacttcgcatacacaaccaaaccaaagaggcaaagcagcaacggtgacacctgcgctatggagactaacagatgtgaggttggtgacaaaatataaaatccattttgaaaggaacgttggaagctttgaaaactctatgaaaggaaattctatctatttctagggtcctggacatgatcctttgttgaatatgaacattgtttactaaaaatcgttaaccataaacaaccatatgcacaagattacataagaaagtctaacggaagtacttttttcccagggaattttctcagtgacgaatccacatcctgaaatttttctagttgccagaattgaaaaggtactacagggaaacattacacactgtgcagaaccctatatcaaaaattctgatccagtaaaggtaatttataaaggttgttgatcaacatttcaccttaacgtagaatttgccttttactgatattttaaatgccattgctttgagcatgctatatattctgaaaacattgtatactgtgtatgtttgctaaaacttgaacatggcatattttcctattgtcattgatgttctgttaatgtgataatctgatttctgcttgattatcaaaataagagccaaaagcttttaggcaacatctgctaattgacaccatatccttgacaatagccgttcttttccttacagccctacatgaagtgctagaatgaatctcagagctgggagattaaagatgatccagtcctatagttcccaaatgtcagttcatacccagatttactcctgtctgtgatgaaacgagaaaagaaagacagacagtgaacatttcatgaagctaaatgtatttaattcaaagggctgccctttattctgagatctttgcccttcctactttttaaaggttatgcgtatcttcctttcatgaaatgt

SEQ ID NO: 138696 - DNA, 1018 bp, Homo sapiens
ctcagtcttgtctttttgggttcttaaagttgtcatgtgatttttttggtcaattactaagaattatgttttttaaatcgctctttgagaatgcaattcatgtatattttttatacatgcaggaatgtgttaatgattattaaactgaatgatctttgcctgtttttttccctgctatagattgtattacttcttcatatgtgcccttgaagccttttgaaaagaattgccaaaatattactgtggaggttgaagagtttgttccagaaatgacaaaatattgttatccatttactatttacaaaaaccatctgtatgtatatcccctgcaattaaaatacgatagccagaaaacatttgccaaggtaaccatgtaaactatacatttttggagtataaaatgttatttataatctgctaattgtgtgactcattttgactgattaatcattttaggcaaggaacattgcagtctgtgtggaattccgggattcagatgaaagtgacgctagtgccctaaaggtttgtttatgatattgataggcatatgtttttagtagagatggagattttggtactcagtagtcttatgctctaggtttaatttgtatcaacatcaaaaagaaaatgttctaaagtgacaaatgtaatactttcttttctactcttacatattaactataaggcttagtttaaatattaatgcagtaggagcatatatagctttaaaaatgccaggttttggcttttgctcctttttgattttgcaattgcttcaatgcccaattgcaaggtcgttttcttatgacctgatagtttataatggtaccatcaagggactataaactcctttctccttgaaacctgaacaggctttgagctgacagaagcacagcatgactgctttgatctgagatacgacttctactccgtgactggccaaatggtgcctccagtcttggattgtggtctatgaaaagcagaatctcagtcttatctgatacagcaatccttaaat

SEQ ID NO: 138697 - DNA, 2019 bp, Homo sapiens
gtggcctaccccatgtgcttgtgtacatggcagatttacctggttttgctgctttgtatagtggtcaagagctgctgagcctgggcattagaataccggataaataggtctgcaagatacaggaggagggagaggtagagagcttgcatttgaggataatgaatcaaatttcatatggctgtttccatctgtgttccaggatctgcatgtgcacaaattcttccatcattgccagctgattcagtcaggctcgaaagaagttccaggggagctcattaaatatttaaaggtaaatgaacagcagctttctgcaaaacgtttgtttttcatgtctttctgttgccacattttggtgtgaaaaaaaaaagcaaacagacagtttaaaatatttttggctgtatttcctcaagagaatactttctatgatgtatttttccatcatgtggctgtttagaagcagacagcagagtggcaacattaggaagaaaatgtaatagccacaatgcagcatcatatttttgaaactctcatgaaaatgtttatttcaggtccataaattgatttttcaggggctttctcttcctgctgactgcccaataaaggtggaggatgctgtgggggaaagggccaggaggaatggaatcactttgacttggaatgaaatgtgaaattgttcttgtgtccatgggtgatagactaacaaaggggctagctaatgaaagacacatattttatgcatgttggcatattgtatcttaccacatgtatagaggacctaacacttggttttttccctgtgtgctaggactacagtgcatatcataatttgcctgacagtggctctcttcttttaattgttcctttagtaagatagctatagcaagtctgaggaaatattattttaaatgaaacatctttaggatttacctttggacatatgctattacttaatgatatactcaggaaacaaaaatgttcatttctttcagagaggtagtatgagatgagatcaaatatatgggttctggaatcataaactgagcttgtatcccacatgtcacttactagctctgtaactgaccatgaccaagttacttctctgagcctttgtttcttcatctgtcatgtgaggataacaatagtgcccatcttgtagggtggttgtgagacttaaatgagatgatggagctgggcatggtgcttcacgcctataatcccagcactttgggaggccgaggcaggagattgcttgagctcaggagttcaagaccggcctgaccatcatggcgaaaccccgtctctactaagaatacaaaaatcagccagacgtggtggcatacgcctgtaatcccagctactcaggaggctgaggcaggagaatcgcttgaacctgggaggcggaggttgcagtgagctgagattgtgccagcctgggtgacagcgagattctggtttgttttctttttttttaaaaaaaaaaaaaaagaaaaaagaaaaagattagggcatctgccggatagtaatcgttcatgccacacttatttctttagtgcttcctatgggccaggcatcattctaagcattggaaatttaagtggagaaaacaaataatatccctattgtcaaagagcttacttgttgagacagacaataaacacataagttaataaatatatacgtcatctcatatggtaataactgttataaagaaaaccagcacaatgaaggggagcagggatttacaaggggtccctgttttaaagtggccagagaaaatctctctagtaaaggcacatttgagcagagacctaaaggaaatgagagtgccagccatgtggatttctcggggagagctgggaacagcaagtacaaaggccccgaggagcttggcttggtgtgtttggggaacagcaagaatcccagtgtggctgggacacagagtgataggacattaccttggggaggttgctgggagcttgtcgagtaaggcttcataagccatggcgaggagtttgaatt

SEQ ID NO: 138698 - DNA, 1030 bp, Homo sapiens
agcctcccaagtagctgggattacaggcatgcaccaatatgcctggctaatttttgtatttttagtagagacagggtttcaccatgttggccaggctggtctcgaactcctgagttcaagtaatccgcctacctcagcctcccaaagtgctgggattacaggtgtgagctgccgcgcccggcctactttcttattttattcatttattcagtaagtcaccaaatatttattgaccatgtagtatgggccagacattgttctggatgctatgaatcaaatggggaacagtttagacagcataccttttctagttgtggtagagagattataagtgagtgccatgaagaaaagagcaggttaatgagatccaacatgaccaggagtgtattctacatagagttgtcagggaaggcctattgggggaaatagcatttcaagctgaaaggatgagaggaagacaaccttagggggtaaagtcgtgtaaaaggataacagaatatcacagtaggtgtaaacaccttacatcagcatgtttgaaggacagaaaaataaaagaccgtgtagctatagtacagtgtgcattgtgaggggaggatggcaagtgacaggtttggcgggacaggccgggtatgtcgtaggcatggaagcttatgatagctctttgttcgtggtagtttgttttgttttgttttgttttttaacaacagaaagatggcaatgtctaatttgcatttcagaaagaacactctggctgtcatgttgagaataaattacagaggactgctactggtagcagggaatgcccatctctcttttctacctggcactattctatttatcatttaccctttctcatctctgaggccttaccagacattccctacccacttgcacactcagttgcttctttgtgcattttgtatattccatgatcatgctatttactgttgatattgcaattatttagttccatgtgtttatcccctgtacactgtgaactacttgatggtagaaaccatggcctttattt

SEQ ID NO: 138699 - DNA, 1088 bp, Homo sapiens
actatgctagctataccgaggtcgactaccaatttaaaacacaagttaaaaacgtaaactgagtattattctaagtgaactaactcaggaatggaaaccaaatattgtatgttcttgcttataagtgggagctaagctatgaggatttaaaggcataagaatgatataatggactttggggactgggggtgggggccagggaggaattaaagactacacattgggtactgctcgggtgacaggtacaccaaaatctcagaaattactgctaaaggacttatccatgtaacaaaaaatcacctcttcctccaaaactattttttttaaaaaacctgtaatctgttaacctcccatccattctgagaaagcattagtgagctttttgaagtctagataagacccggcagttgacagagtaaatgaaaatacatttgagtgcagaactgaaaaaaaatcattgaatttacacttaagaccaacgtatttgacaaagataattgggcacctttagaactctttgttttctatcattaagtgccctttgataatgaagccaagagggaaggagcattagagtatattttaaatccctgatacatatccattgccaaaaatgttttgttttctctaattcctaaccagtttctcttgaagtacattataaaacatttttaaatcaagatggaataaaatactactcatcagttgacacattggaagcagatgttctactgtgtagcgtttttaaggaaaaaaaatactttgccctattggatcattgcctaagcagggaagggcttaggggcccttgcccctcaaaggtgactgcacagcacccacaagggaccatttccagatccttttcttcactgtgtcaggcactgaattgacaggaaaagggaaaggaggtatgcagtactccctgcccccaccctcaccctaccctcaaacttctttcaggcagcctgagctcttgcttgttctaccaaagagacttaaggatcactattctcttccctttattgaaggcacctcaaagtgataatactgagtgtcagctattctccttcctcccaaaaaatataaaa

SEQ ID NO: 138700 - DNA, 1048 bp, Homo sapiens
cataatatcagcagatttgtttttgaggccccttacactttatcaggcaaaaaacagggctgtatagaagaacagtgcaaacgccgtacaatcttgacaagtaagtacaattttacatattaacttcttatttgtcttggtctttttcagcatacacgagtagcagctggccagctggaacatacaactgaaattttaattattatttgttctgctgttcagttacaagtttgcacaagcacgtccatgtgataaaccatcattttcccatatgtcatccatgattgcccagaggtgtctcataaagagaatttctctctgaatcctgaagtactatatgggaccctaagtcatcttctagataaaggatggggagagttaagcacaatagagttttttctttaatttggctgtttgaacaaatgattttctaaagtcagtaaatcaatcttaacattttaatagcttcaaactcgtttccttacgtgaagaagaggattcctattaactgtgaacagcagattaatttaaaaccaattgatgttgccactgatgaaataaaagataaaactgcagagctgcaaaagctttgctcctctactgacgtggacatgattcagctccaacttaaattgcagggctgtgtttctgtgcaggtacgttggtcatccaacatgtattgaatgtttcttgatgtttcttttggttttataagggcacagagcaagcattaattgtaattatgtgttgggcacttactgagtgcaaaaacctgtgcattattttttgttcatttaatgaagatattacattgaattttttaaagttttgtgttatgtcagaggactttaacataagtccgatgactgtagcgaagccctgtatgtacatatcagaaatcactaacttactagaatatcatctttgtagattattttctttagttaatggttttttgaaataaacttgaaataagcatatatttctcagatatggatttcttgtatattttgggatttttaataaaaaagagaaatgccaaaacttc

SEQ ID NO: 138701 - DNA, 1075 bp, Homo sapiens
gtaaagagagtggatataatgtatatagcgttttttacctcaatctactttaagcacaagatttctgttgctttttctttagattacacaaaatggatcatttaaaaaatatttaaactaatacgaatatctatgtttatatacttactggaatacaatctttaaattttatatttatgaagttcttcctttccaagaaaaatcttctgtatcaattagcttatacaattataatgtgtctttagaaatatgcacttaagacttttatcttcatttactattattttcaagtctccagggaaggaacataggtatctgcatgtttcaaaagtcccatagatgattctgagaaccactgtgttagatcattcataaactcatgtcagagtctaccatttagagctcttgttatgaccatctgttaaaaaatattttaaagattgtgttacctctcgctttttattgaattttgcattttacagtctttgtttttcttaatgagtaactagatcttttctgcttttttgatatgctgcctttgtaatacagctttgaagacttaagtcggtaatgttattctttgctctctctgctttctgtctttttaaataactgtcagtgataaattgaaatatgcctgcaatttcatatacacattctttttttggcagtggctattttgcttcatgataatcatgctgatttcttctgttttagatattacaagaagacacaatgcattctccctggatgagcaacacattacatgtattttgtgcaattagtggtacatcaagtgaccgaggttatggttccccaagatacgctgaagtgtgaggaaatgcagatgtacgtgacaatgagactgacctttctcaggaatatttggagctgtgcaaatgttaaaatttaaagatttgatatacatggagtgtttcttctcgacaccaaaattttcatgtgttccaacagggtgcttacatatttgtaaataagcaacttgaaagtgcctggaaaattgcaccactgtgcttggtttgtacttttttaggtaaatctatatgctgaaaagtag

SEQ ID NO: 138702 - DNA, 1026 bp, Homo sapiens
cagaatacaaatccctgatatttggaggacagagtacttctgcccacatagcccacaagctgtgggcagagggctccaggaacatgtgcacagccgcctgccatggggttggggatgaaggatgggcagctactactatgtaaaagctgacattgattgaaatttatggcaatttgttgttcaagcctttcctgggaaattgcaagccttcaatgtaagtgtttcctgatataactctgcagtcttccaaaattgttacatcaaacagactctgccactaccattgttatctaggtgaggagatagatgtctggtgcttcctactcttgccttattcccagaatccatgtgtgtgtgtttttaaagtgtaggaagtagaaaaatcaaaagatatggaggaaaccagaagagaaaaagaaaaggatagcagatagccccaggaagcccaaaatgcaaaccagttagaagatctgaccaaaggacacttcaaaacagatgggagaatattaatcccatttgaaaggttgaatatagggcaggccattgttttatttcaaaactgaggttaaagtaggttttaaattaccttgaaaataaattggagtacaattgaaatgaaccacaaataggtatatttttattatcagggctttaatatttgtgtgggagtgggaggtaggtgggtagggagagtactggaagtgctaaactaggtttcttggatgtgtttctgggaactgcagaataaggcagataatcctacagtaaattgtagtctccagtaggaacaatgtttttattggaggctctctacctgacaaatgatttgtcttcaaaaatatcattgatatggtgttagaaaggccaaaatggaatagccatacatgcttttaatcacttaaaatcctaactttagcactgttgcctgagccattggtgctccctggtactagctcagttttaatgcagtgcaataggaattctttgtttccacaaggccttgtcctgctgtgggctgctccttcc

SEQ ID NO: 138703 - DNA, 1027 bp, Homo sapiens
taatcccagaactttgggaggccaaggtgggcggatcacttgagctcaggagttcgagaccagcctggccagtgtggcaaaaacccatctctactaaaattacaaaaattagccaggcgtggtggcatgtgcctgtagtcccagtaacaggctaggtgaatcacttcaccccaggaggcagaggctgcagtgagctgagatcgtgccactgcactccagcctgggttacaaagtgagattctatctcaaaaaacaacaacaacaaaaacatgaggctaatactagtccctatctccaagattgttgtgaggattaaatggattaatatgtgtggaatatttagaatagtccctggcccagtaaatgttagatgttgttaactcagttattactgtcttgtcctctaggacttgggagaattaagcaaaccattaaaaatactgttgataaattcatttttttttgtccttgatttgaacagaaactcagccacctgtgacaaatttgagtgtctctgttgaaaacctctgcacagtaatatggacatggaatccacccgagggagccagctcaaattgtagtctatggtattttagtcattttggcgacaaacaagataaggtaagttttctgcaacatgttacattgatgaggtaaagtgaacactatgaattggagccaagaataagccaaattctagtcttacgtcaaagtggaaattgtattttagggtgtgtttaaatttcagttggggaaattatagaagcaactattgacacaagtgaacacttaaaaatatttgctaattatttgacaattaaatgcaattgagattgctctgacaggaaatactagatatctttttctctaaggtactcaataaataattatgttattgttaaaatttgttcctatgttcctgcctgtagctgtattgccttgtatctatataacacttaattttggggaatttttacatttaccatcttgctaatcacatggacaaatagatgtacaggcactatgt

SEQ ID NO: 138704 - DNA, 1028 bp, Homo sapiens
cagtgaacatgacacctgacaagtttttttcttcatgaaacctacataatagaaaacgtaagtaaataagcaagctaatttcagaggatgagtgctgtgaagaaaataaaatgggctgatgtagtagagtgactgggagaacgagagggaatattaggtagggaaatcatctgaggtaataacatttgagatgagaccagaatgatgagcagacgctagccatgtgaagatctgggtgtagggggtcagcagatacagactctgaggcaaaaatgagcttagcatgtgtgagagaacagaaaggagggtggtgtgaacaaaatgtagcaggaaaagatgtctaagcagtaggcagacatcagatcttgcggacactttggaggctctgataataccattctgttttcttggagtttgtggcaactaaagtaatcagatttgagtagtcaatatttgttggattatgtgcctgtatgctattcagaatcaaatgcagaacatgctaattagaggccctgtaggacactgaccagagtgtactataatctcaggacatcagtccagttgttctgctttagggtaaaggtcacaaactagggcctcacacttttttgtgtggaacacaaagtcgtgttttgtttgtttgtttgtttactagatttgaattttttgcccagattttaaatcatagtactttaagagtgtgtgtccataagatggcgccttaagaccatgaagactgcaccactcacttgtctgctacctgcctggaccctttgtgtgtttgagttttagagattagaagtgaagtgttttatattggcttttaaaggagcctagcatctcgcacgtgggtaaattccttggtccagttgttttagctcatcatggaacttccaaaatgcttgctaaaataagccagtgttgacaggctataattccaactccagagggagtgaccaagtccacagcagaacagaacagcaaatgctcttctgggcatttgcattatgaatccttctgctgaa

SEQ ID NO: 138705 - DNA, 1316 bp, Homo sapiens
cattgcctgtttatttccctataaggtgtcatttgatcaacaaatgtttttaattttaatatggatgactttattaaaaaattctctttatggttaatatgggaggtttttttggtcttgtttaagaaatatttcccttcttcaaggtcattaagatattctctgtttttatctaaaagcttgctatagttatgtatttattaattcattttatcttacacatttaaatctgcaatatatcaggaactgattttgtgaatagtatgaggtagggcgtcaagaatctttttttttttcatatgcatatgtaattgacccagcaccatttattaaaaaaggccaaccttttttcactgtacctgatcatcttttaatgggataaaaggaaagcttgttagaaatgactaggtgatagaaaatgggtttttaaacatttaggactcattagtttatttatttatttttattttcaaggtccaagaggctaaatgtgagaatccagaatttgagagaaatgtggaggtcagtaaattcaacattagctatttgggtttagacttagagcagttgggggtggagcatagcctaaatatgagctgctttgagaaaaacaaattacgttgttccgtgagttattgacaattttttcgaaaagtcaaagataatttgaattgcaatccaagtcttaatcatagacagaatttggcagataattgtattatgattcaataacagtgaaaaagaataaactggtaatattccttgtgtatttttattttatgcctaagaatacatcttgtttcatggtccctggtgttcttcctgatactttgaacacagtcagaataagagtcaaaacaaataagttatgctatgaggatgacaaactctggagtaattggagccaagaaatgagtataggtaagagaacagaatttttattaaaatttaaaacactgatgtataaaaactaagctgaagcagaaaatagactggggaaagggactgtcatgctctcttgatgtcaggaaaagagtacttacaattgaaatttattttcttcttaatcactttcaaaccacccagggttaattgacagtatacagttatttagaaaaccataatccaaatggttttatgttcttttctatctcatttccatttttattaacaaactgaacaaaaatatagaaagcaggcataggctgcacacagtgactcacgcctgtgatcccagcactttgagaggctgaggcaggaggatcgcttgagcccaggagttggagaccagcctgagcaacatggtgaaaccccat

SEQ ID NO: 138706 - DNA, 2464 bp, Homo sapiens
ttaatatagggtctttcggcaatttcgattgcagtaagactttaggaacatcttatgttttaccattcatctcaatgctacttgactttttgaacctattatgtctctggagcaatgagcattaagaaaataaaggtaataaaggtctcagcaaaacagttggagtaagaacggcatgacatccttttattcttcttaatagattttatttccagtggtggaaatgtccaaatttgtttatttctggagatagtcattgtacatcatgtaactatctcatgattcccacctccatttaatattaattcctgattgttctgtttcattaatcattcagatagataaagattcttaggtcaaaaaaaaaaaaaaaacaggaaatcatacccctacggttccatccacacaaacctaaaaataagcattggcactaagtactcagggaaagaacactgtttagatatgtcattgtgtatgtgtttttttcctcccttctagcactggaagaagtacgacatctatgagaagcaaaccaaggaggaaaccgactctgtagtgctgatagaaaacctgaagaaagcctctcagtgatggagataatttatttttaccttcactgtgaccttgagaagattcttcccattctccatttgttatctgggaacttattaaatggaaactgaaactactgcaccatttaaaaacaggcagctcataagagccacaggtctttatgttgagtcgcgcaccgaaaaactaaaaataatgggcgctttggagaagagtgtggagtcattctcattgaattataaaagccagcaggcttcaaactaggggacaaagcaaaaagtgatgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtctgggctgggtccggtggctcacgcctgtaatcccagcaatttgggagtccgaggcgggcggatcactcgaggtcaggagttccagaccagcctgaccaaaatggtgaaacctcctctctactaaaactacaaaaattaactgggtgtggtggcgcgtgcctgtaatcccagctactcgggaagctgaggcaggtgaattgtttgaacctgggaggtggaggttgcagtgagcagagatcacaccactgcactctagcctgggtgacagagcaagactctgtctaaaaaacaaaacaaaacaaaacaaaacaaaaaaacctcttaatattctggagtcatcattcccttcgacagcattttcctctgctttgaaagccccagaaatcagtgttggccatgatgacaactacagaaaaaccagaggcagcttctttgccaagacctttcaaagccattttaggctgttaggggcagtggaggtagaatgactccttgggtattagagtttcaaccatgaagtctctaacaatgtattttcttcacctctgctactcaagtagcatttactgtgtctttggtttgtgctaggcccccgggtgtgaagcacagaccccttccaggggtttacagtctatttgagactcctcagttcttgccacttttttttttaatctccaccagtcatttttcagaccttttaactcctcaattccaacactgatttccccttttgcattctccctccttcccttccttgtagccttttgactttcattggaaattaggatgtaaatctgctcaggagacctggaggagcagaggataattagcatctcaggttaagtgtgagtaatctgagaaacaatgactaattcttgcatattttgtaacttccatgtgagggttttcagcattgatatttgtgcattttctaaacagagatgaggtggtatcttcacgtagaacattggtattcgcttgagaaaaaaagaatagttgaacctatttctctttctttacaagatgggtccaggattcctcttttctctgccataaatgattaattaaatagcttttgtgtcttacattggtagccagccagccaaggctctgtttatgcttttggggggcatatattgggttccattctcacctatccacacaacatatccgtatatatcccctctactcttacttcccccaaatttaaagaagtatgggaaatgagaggcatttcccccaccccatttctctcctcacacacagactcatattactggtaggaacttgagaactttatttccaagttgttcaaacatttaccaatcatattaatacaatgatgctatttgcaattcctgctcct

SEQ ID NO: 138707 - DNA, 1168 bp, Homo sapiens
gcgctgtgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttgggtgagtccaacgcgctgccgggccggggctggggctcggtggctacatgagggagcgggagaacaaaccccgcagcgagaagggatttggaccagggcagaagagggggcgggggacccatggactgtggcggggtgggggaggggtgattctggggctgggtctctgagtttgttctgttttcactgcttatctgtgtttcactgtgtttgtgttgatctcggttgctttttgtcttttcctgctacttctgttagcttttgtgttcctgtctctcagtccccgttcctgtctgtgtctccttgcttctggttctttttctccgtctcttcgtatctttgtcactgtttctttctttttcggtgtcactgtctctgttcctctgactctccttctcccgctgcactcctggtctcctcttacacctgctcgcaccttcccagcgaggagaggaacttcgcgcgctcctcgcacttgcgcccggtcctctgggctgtagccagcaggagatgtccggtcggcgcctgcgtccgccgctcgcgccgccgggtgttgccccttccggggccgcggctccctgtggggtgggtccggcatggaattaggtcaggagagcactggttgcataagggccgcgagcggcccgggtcgggcgcccctcccccgcgcgagcgggcgggattgtgtaaccgctgaggtaactgaagtgggccaccacgctcgcttcggaaaccatcccacgagcatgtgcggggggagggggagcgcttgcgccccgctgccctgtgactcattgtcaccgcttcctatcacacgatcctcggctgaaatagatgcccccccttgcccgccccgccaacccgtagcctgtgccctcgcctccaacccctttaacctggccagcccggcgggaggccggcgcggcaa

SEQ ID NO: 138708 - DNA, 1100 bp, Homo sapiens
gagttgaaatgacatcaggtccagctgcctactggaccctcccctctctgtcttatctaggaaggggagtgagggtgctgtcctccttggcatttggggtcctgagtgggtggttccctgggttaaggggacaaaagggagatgggagtgttaattgattgcccagaaacaccgtccttctggtgtgtacgatcagtttgggcagtttctacatttttgtaggagcctgtgaggaatgttcttgcttctttgactcagggtctggattgtcagtgggagaaaaaccaaaatcaagtacattaatatggggattgaggctcactgaggacattctggctgttgatgagagatccagggcatggggctacctgctgttacataacttttctttggctgaatcacagttttcaccagccacacatgacagccagcccctgggaagggacgttggtggtccccacctcccctatcaccatacacagaactccaaccttcagctcctttgctagaaataaaacacactgcctcacaaatgctagtcagagaccattacaatataatgcaagcagtcgttccaactcttgggtcccagcagaatgtggtagttataaaagaaaaatggtgtgaaatactgagagcattagtgaaggctcagccatcttcaattcatggactttgttgcttattgttctacagtttactctgctggtgtctgggtaatcggcctgtaagttggattctgacagttggcggttgtctctgctctccttgtgccccacccactattcaccgcggagccttacggtttctgtcccagtgtggtttggcagagcagtggataaagaaagtgagcaagagacagaactggtttctgaaggctctagaaaggaatagttagcaaaatcaatgaaataagggaactggccctggattttctgtctcacaaaagatctcctttctgggaagttgctttgaattggtttgagtatgtgaaaaaggtgtgcttgagaggagcacggttcggggagaattgcttcaagctgtggacccttctccaaatcttaagtgtagtccatgatgtaatgataataataatagct

SEQ ID NO: 138709 - DNA, 1048 bp, Homo sapiens
aggcaaattattcacatgctcccccaccccaaaagaaagaggctatgattatggtgtgtgtaaccatacacaattttttaaaattgcttacatgtctttgatttcacagctgtgacttactggcttagaggagaggctccctgctctgtcatttactggctgttgacctggatggagcaagtgacattctctgctactgttttcttgtcagtaaaatagagaacagtgtacctactccatagggttgtcatgattaattgagaaaaatctgtttaacacctggaatagtgcctggcatataatagatactcagtaaatgttaactatttttttttccttgtagaccagaggtccagaaggaaactttgggtctatggacctctgaggatgttctatatatggattctaatagatgtattaatgtctcgaagttgtatgttaaagtatgtgggttttccaggacaaggtccacatcctttagcagattcacaaatgtgtctgttttccaaaagagcattaaaaggaggctgagatatttgcacaaaaattaagacggttggcaggctgctgttcgttgtgctggcgggtcctgcggggagggctgtggagctccagatggactaaagaacaaaccagcaatcccgagagggcccacagtccctctgaaggaagcgggttgcttctgcaggacccaggagacaccccaaatactctgggaggcaaatagcctcggtcgagttctcaagtccctctcactctcctcctggaaacagacttggagctgttggggagggcacggtggaagtgagactggcccttcagtttgcatgggagctgggtgaggcctgtgactgctgtatttccccaacttccctggtaacctgcatgactcagcaaaggcagccataatcctcctaggtacacaactccagtgacctgggaatctcacccccatcccccacagcagctgcagcaagacctgcccaaggagagtctgagctcagacatacctagccctgcccccacccaatggtccttccctaccaac

SEQ ID NO: 138710 - DNA, 1017 bp, Homo sapiens
caaagccaaggtagaagatagagaaatcctgcttccaggcagagcaatgggctcctgcaggtaacaccgttgtggctctaagcccatgatgtgcgctgtggagtagacttgacttagcctgctcagagaccaggtctttgttgtgcgtatccttcttaacactccctccaacatccaggggacaagaaatcaaacatacagactcatcctgtttgtgttttctctgaaaactaagaatcctgaggtgtaagttcttttgttcctctgctttctccctttcatcttgtttgtccttgaactcaacagggggctttggaggaggtctcaaaatttggtccaagaaataaacaccaagaggataagacccccttccagttggctcactcgaaatttaaaagccatcatttcccttatcctgcccctccgttctaagtgagacttcaaaacaaaacaaaacaaaaccctctgtgcctggagtagccattgcatacactgctaagttatagctggcctctcactgcttgatggtgataagaaacctactaaatctagaaagaactttggatcttgaggttctgaaaactgcagccattggtcagaagcatgtagttccctttccaacagggtttgtctataagttagacattggatgttgacagaggctatttcaaacacatgcttcagcttgaattatgatagccttgacaaagcttttgattccacctctccagtgtttttcttctctttcttgttgttaggaatatgattggttctcttattaccctcatgtgtccttgggggagagtgtctgagagtaaagaaagtgtctgaaacaatctgtggaggtcatgaaattagacatttgtactacttgtgcaagattttagtatgaaatccagtttcatggtgctgcattggtagaaaaacaagttagagtatgaatttgtatacacggattctagagagaaaattaggagaagcaggttgtaagttccacagggaaaagggtgaaaagag

SEQ ID NO: 138711 - DNA, 1049 bp, Homo sapiens
ctcctcctttcctctttgctctcatttgatagcaaaagaaaacaatacaaggatgtaactggtgggaaaagatagctatttccagacaagccaaacattttatctgggctgacatcaaactgaaagcatttattattgctattgtttactccatcactgtaacaatgtaaaatgttttttgtgtgaaaatctggccctgctctgatttataaatacctcttggatgtgttttctgaaatcgttacctaaagtggtaaaaaaattctagtcaagttctctctgtctctctctttttcagaaggagggagagaggagagagggagggaggaaaatgtgcatatgagtgtgtgcatctacatgtagatggatgatgtctatttggatgcagaaatacatgcacacatttgttgccgcatcatagagtgaagaagaaagatgggcttgagagtcagatctgacctgacatcccaaagccctgctacttaccagctagctgtgtgatcttaggcaagttattttaacctgtctgggtttaaattttctcaatagtataatgaagctaatcataattaccacctcttaatatacaaagttaagtattgacacaccaagaaatacagccagaaaaatatattccatctgttccagtcactttggctgtgcagagaagcagagtagccctaaatatagaaatgaattgagtattgaaaagtgtaatgtattctaagcatctgaaccctgaactatttcaaaggaataattatgcagcatctgtggccgcatttgtgtttgctaccactcagtcaggggcattttaatcacagcttttgctaagagattgctgtgtccttttgtgtgtgttttattcatctgctcactaaatgtcagtatttattgcaattaattagccagctatatctttgttattttagatagattacattaggttacattcttaaatgaacaataggcccaattgcaaaattctcaggaaaaatggttttgcatattagttgtagatacagattcatcaatcatcttcatcatta

SEQ ID NO: 138712 - DNA, 1047 bp, Homo sapiens
aagccaagcattgggttaggctgggagtgggacagggcaggaaaggttcagtgattgaaaattgctttttagttccctgaaacttttggccactaactttgagcatatcccagatggagacaatttctgtgagcttgtaaatacaatcatcagaaaatggaaagggaagaattccccccaccctactttttggacaagaacatgatcttgatttcagtgtttcagaaaaactgtgagagttttaaaacttcaatgcaggttttacccccttgttaaaaatttttttctaattataaagataatcaattgcatgtgtgtttttttaaatgaaactaacatccagaaaatacatatattatgatggtaacagctgctaatttgtgggtccagattactccaatatgtgggtcatttgacttgttcactgattacatcagaagtgttttgctgattgctacgtattacctaattgcatattgtctaattgcctccccccatgtagtgcttggcatcaagaaaatacagcaaaaatgtaataatggaggagctcatagctaaattccttccagaagaactgaaggaacgaaggaagctttatgaagaggaaatggaagaactttctaagtatgtatatgcatatttctgttttgtttcactcataccagctcaatgagagctgaatgtgcacattacttcccagcttccgacttagtgatgtcatgctagctgcttgaaattggctatggtgagagtatttacaccatggaaattggcaagtgctacaaaccagggtttccgctgcacccagagagccagttgttaaacataccagcataccactgaagaagcataagcgaaaccagtgatgagggtacgccctgcccccagtaacagggtattgttggcaagagtaaattggagtagcataaacaggggaacttaacgaaatgtccaaaagattgttttcagatacataaggagttgctatgaggttaagaactttggtgtcaaccagaaccgggcttaagacccagttctacctcaaag

SEQ ID NO: 138713 - DNA, 1037 bp, Homo sapiens
tacctagggggaaataacaatactagaagtgtgcagtttttgcttttatcttttttttactacaatgacactagttcttagaccatttccgtatctatccaaatggatgcttaaaagaagttcagaatgatgctaagatcatctgtcttcagagtccacttttttttttcagtttgaactaaacaatataaaatacttaagggatttggcctagattatggtatatgccaaggtaaagtaaaataattcattttctgtgtgtaatacagaacaaagctgaaagaattatttttattataggcatttacttcagcaatctaattgtacgtgtatctaatttttccccagtgcagttaggaatcggattttgggcaggatcataattaactcttcagaggaaatggtgttcagtttagcacatcacagtcatgcccaactagcctccataacccacctctccccggggttctgaggatcaagacctggacagaaacacttgataaggactttttattattaaaatgtaaataagacaaatagagtagaaccctataaaaatctttttaaaggaaccagatggccgggcacggtggctcacgcctgtaatcccagcactttgggaggccgaggcaggcggatcacttgaggtcaggagttcgagagcagcctaactaacatgatgaaaccctgtctctactaaaaatggatacaaaattagccaggcttggtggtgtatgcctgtaatcccagctacttgggaggctgaggcaggagaatcacatgaacctgggagatggaggttgcagtgagccgagattgcaccactgcactccagcctgggcaacgagcaaacctgcgtctcaaaaaaaaaaaaaaaaaaaaaaaaagggaaccagataatctattattttacctaagtactgcctttgcttctagttgcatgggtgaaatatttcaatgtatggggagaatatagggtgaggagtaagagtaagccctgatttagcttgcttagtgctagtttgagtccttcagtg

SEQ ID NO: 138714 - DNA, 1106 bp, Homo sapiens
ccaattttctgtagacaacctggagaaaagagtgcctgcccctgacttagcggggcagagaatgacaatttttaaagtttgccttttctgaaggttgcttttagcccagtgctgcctcagcagcaaggggcaagcagagtcattgcgcatgtggcgcttccagctctacctgtggagctggcctgggctcagataatcccctgtgactggccattggagcggcggagctcctgaggctagttcacagcacccagaggtctcttacagtcaacagattgcatactgttgacagactgcaatccgtctgtgttccccacaccaactccatttccaagatgggaattttattcaggaactcatttttgagttcccaacatgttgacttcgcatccatttctgctcaccaaggcagaaccatagcagtggtgtgtgacaaagatgcaaatggagggcagcccaaacaatggaaaagagaagattttcagcccattcttggggctaagtgaggttttgatttatggtagaagacagttctaaaaagcagctggcagcatgggcttcaatttgtggcccttctgagttcaaacagaaggaaggaaaaggagccacataaagtgtacacattcaattcatcttagaatgatagctcccaccttattacactgtacaactatttaataatctgggttacacacatccagaggtgaaataaagaaattttcacttacaaatgtgtatttccaaacatgctaagttaacctccagagagaagtgcctgtaatctctgttcctggtgtcactttaaagcttttgcttcatgactgtagctgttgtttaaaatgtttttgcagcaaacgcgatttaacagaagtttacaaagcaacactgtagctaatgcataattttaaaagttgactaacatttatctattgttaaagcaacactaataatggaataaaaggaaagcaaataggccaatgtggcaccataggcttattttaggtaaattagttccatcatcttatgcagttgtaagtaatgccaggattaaaatatcaagcaagccacgtaaacagtggcaaatgtgtgtgtgttttccatttgtt

SEQ ID NO: 138715 - DNA, 8725 bp, Homo sapiens
cacagagcccggcaatgccgaggccctcccaacgggtcggtctgcgaggagcaaaaaaggggttcagaggagggcagcgcgtgcgtcgcgctcagctataggatggcgcgaggatggcgtgaggctgggctggggcctcccaggtagaactgaggggggcaccgcgcggccgcgggggagcggcgccggactctagaggctttggagggggcctgagggctgcggggcgggaccgagcagggcggggcgcttaggtggcctcgggggaggcggggcttggaggctccgcccctcaggccccgcctcctccccggctagtctttggccgccgccgaaccccgcgcgccactcgctcgctcagagggaggagaaagtggcgagttccggatccctgcctagcgcggcccaacctttactccagagatcatggctgccgaggatgtggtggcgactggcgccgacccaagcgatctggagagcggcgggctgctgcatgagattttcacgtcgccgctcaacctgctgctgcttggcctctgcatcttcctgctctacaagatcgtgcgcggggaccagccggcggccagcggcgacagcgacgacgacgagccgccccctctgccccgcctcaagcggcgcgacttcacccccgccgagctgcggcgcttcgacggcgtccaggacccgcgcatactcatggccatcaacggcaaggtgttcgatgtgaccaaaggccgcaaattctacgggcccggtacgcggccggcgaggggggcttggagacaaaagaagggggccccggcacggggctgggcgggagagaggcgaggcgggagcggggcgcccctgagtggagggaggaatggcggcgagctagggtaggcgggtaggcgggcaggcggagagccgggaggctcccggggcgggcagggaacaagaggcgctctagaggggctgcgggccagtcagggacgcggatccccggcccgcgctgacagcgctgggagggggttagagaaagaaggctgaggcgcttaagccgggggtgggtgggaccacgaagctcgaaggcgttgaggggggacacatcaaagcccaggctgttggggtagttttcgaaggtcctgggcttggggattcctggaaggaggagggggtagtgtcgggttctaggaaggaaatgagggtgttccgagggaggcatgggggagggcgagagtgagaaaaggtccagacctagagaagacgggaaggccaatgacaccgggagtaggtttgaaatatgagggtgtgggagaaaacgccgagacgggattagcagcaggtaaaagctttgtgcccggtggatagtgatgtgtgtgtgcactcgtggtgtgtgcatgcgcggtgtgtgcgtgtttagtgtatgtgatttatcaggggtgtgtgtgtgtggtgtgtgcatgcgcgcttgaaatgggtcatgcgtcaggtatgtgtgtggcatgtgtttggtctgtgtgcgcttgtgctgtgtgtggcagatggggaaaggctggaaggtgaacaaggaggaagggggctgtttgagggaggaataaaggctgaatatggtggacaatggtaacgtggcaagcttttaaggtaatatggtatttagtctatagcaggagagaaaggattagaagccaagaaaaattaaaatggagggagggagaagtgggaggataccaagaaacaaaaggagtagagctaagaagactgctgggtggggggatatcaggaaaagccaaccagagggaaatgaagaatggatgactgctgcactgctgagctgttggagaaggcaggcctgatgggttccttagaggcgaggtttttgcaaacctggttgcgtatcagaatcacctgatgcatctgaggaaaaatacagattcccagtctaaccgccagagctgcaaatgagtctcgggtggtccgggagtctgtattttaatatgcttcccaggcgaatttgaaaagcagccaggcttgcaaagtcctgctttatagaatacttggagatgaggaagaagaggttttggctcctccaatatggactcctctaaacacagggagcttagaggatgtccacatggacggtgctcattccacactggcctgagagagggaagagtacagaaggcagtacacaaactcaggcattcattttagtctcccagtccaactgatcaaaatcagatgtgttaaggttaaggagctcagttttttcttgcagacatttatttattataaaaaataaattttatttattttttagagacagggtctccctcctgtgttgcccaggctggtctcgaactcctgggcgcaagcagtccttccacctccatttcccaaagtgctgggattacaggcatgagccactgcaccgggcctgtggatattttagaatacctgctttctataggcatgtaactgtcaaaatcatttgaaaaccacatacattatttgtcacttagagtagcacacatagttgctttatcaataaacataatcatgtaaatacctgttaatattgagctcaatattaaaggagtgaaaacatgtgcatgaggcatcatcatgactgtagtttgcagagtcattgagaggatgtcagcctgtgcacagagcacaaaactgggagtcaggcaacctgcgttctagtcctgattgggtcatgactagctgtgtgaccttgtgcaaagcattgttctctcagagccttagttttccctctgaaaagtgataaagatggcctattgtgagatctctgtctctatcttgcactgtcattcagtgagcccatgactacgtgacatcttggtagaaagtgatgcttcatgttgtaaaggattcctaaaaattagtcattctagtgcctgttaattctgtgcaaggcactgttgtagatgtgggaatatagcagtgagcaaaacagacacaaatctctgcctatggagcttacgttctagtgaatatatgttgcactgaataatatgtatttttaaaagacttttaatgttcccactagagaacatttaattgtttaaatgtttaaatattctatgaggtttaaatattctatgtttaaatattctatgaggtttgcttggtaaagactcactctaccaagccaatgaccataatttctgaaatggtaaggttcaaaccattgcatttgcctattctcaagcactaggtgctgccatttccactaggggtgtacatttatgaaaaatgtgggcttttttttaccttctttagtgaatgtggcagcatgtaatgatgattaaaaataagcatttttctttggaattttacttgcatttaaaagttgtaaaatttgtaaaaaatttctgagtgtattgaggtttcaggtgaacaggccatattgaaacttgatctattctcatacttggttccctacaaacattttaatgtcagggctgctattcaatctgccttgggggaaacaacacattgtttaaagtacactggattctcttcatttagttgtgcaatatttaaataagtctaaatatccactttgtgtacccacagaatgattctctgctctcttagacaaaagttcagtataatatcacaaataatcacattttatagagttgttttatagagttgttttgcagtattgattcagcctcttttccatgaaaattttagtattttcacagtcttctcaagcccaccaaaaaacagataatgaagactgatctctgtgttatctatttattgacagtgaaggttatgtaatgtggatagatttttaaaccaccgatactgttataaaatggttcttctgcagatgccatgagttaatgtttaattgagccttggaaccaaagatctctataagatacctttgtttcattaaaacatatcagaatatattcataaggaaatgtgttttcatgtacacatcagtgcttattatcttaagaaaccataactctcactggtgtagccccaagtgcctagaactgtcaggctcccagttcaatgttcttgtatgattccctactaccactaccccaagagatcactaaccacgtatgacttttttactagctatttggaaaccacaggagactgacgcaaatgtatagcagtttgatttacttttagttatttaaaagttaaatgacaacaggtctttctgtgtctcctacataatgttcagaatatcagcattactatggtttcctaatggaatttgatattcaaaaatggggctatgttgatgaatagggaagccattttctgtgtataaatcacagagaaattgactgtctaataaagaattgatctttggttttgtttttgaagaggggccgtatggggtctttgctggaagagatgcatccaggggccttgccacattttgcctggataaggaagcactgaaggatgagtacgatgacctttctgacctcactgctgcccagcaggagactctgagtgactgggagtctcagttcacttgtaagcatttttaaaattgtgtctgggtcaaatttctaccagtaatggggattcgtggcaggacaatagttattactaagcagcctgaaacttgggtgcattttgataggctccttaatcttggacgcatcaagttcatggcttgaagtaattgtagcagtgctgagtcacttgctatgattgcataccaatttttagccagttctctatggaaacttgggtttctggttttgattttaaaatttttgagagatttgctagattccaaatgaggatttggtgcttggtgtgtcagggaaaggacagtgtccatcttggctacagaaagggattttcataagccctctcttgtagagcttgccgtttaaaagcagcccacatctctgttgaagaatgggagacttgtattctgtgaaacagcttctctttgaatctaattgaacctaactataggcctcatctacaaatgatgcttataatgtgcccagcagcaatggtgtctgcatttttaaaaagaaagtaaaaaggagatgcttgtttctggcttatgctatgggctgaggtctttggggagaaataggaatgaggggttaagttcagattttgagaattcaggaattggtttctgtcaaatctaactgtttaattgtcactctagcaatatttcactgccaagaatttgaataagagtctttcccagcttttatgaaacagtatataaagaccatgagcattatttgaagatttttcatttaaaatgtagttttctatgtgtgttctctataatcagttaaatattacatgttctcttggctatatccaaccattttctttgaaaataatgctgacttcagagagagttctggattaataattagccagatgtgtctctgcctttgagttttggtctcaagcaggctacatataacttccaagtctagaggcaagtttttatactttggaaaacatagttcagttacctaatagagtccctaatttttggcatcataaggatgcctttgtaattagttttctatatgaaaccagtgaattgtagtgtctaacttacaaagctctattttctagggcttgccttcatcagtgggagaaaaagtgtgattttttttttccactttaaggctagccccagatgctgttgtgacacctcagctacacttaaagttggtgtggattccccttaaggcaggtttcccaggagccacctggcttttatttgtctcacacagttccaattgttcccaacggttatttcacacaaaagcagctttagttacctggttagacaggttggttactcctctaattcctactcatattcaggaagaggagactcttggctttggacattcagatgatcgaccctgcattagtttggctacagtgatgaggtggtttgctgatgccatctcttctcaagtcttttgcattctggtttgcacccttacatctgttttctccaacacctccagtcatctcctggctcctttaccacttcctttaaccacccataggtttttctctgtgctgggaaaaacgttctgtctcttgctctcctcttcatctatgagactattattccttcctttcactgtcaaacaaacttcttacaagtttttattcctaaccactacttcatttcctctctataccttcttcctccctacaatatggcttctatccccacaattggattgaactctctttctgaaagattttcagggaaaccttttttttttttcttgccaatcctgacttcacttgtccattccatgttttagatctcctgtcatgtgagcctccagaatggctccctccacagagttcccattttggtccatgggagctccaattttcacttaattaattcatgcttccagttttctttcaaagtacttctcatctgtccctttccattcccctggacaccaccctgctcctggcgctggttcctttgcatctggatctgcactctgcctctggatcgccctgttcccagtctctccttactgaaatctgccctatacaccacattgataatatcgttgttaaagcactattttactgtgtcattccttcgcttataaaccttcagtgccctttgccacctataagtccaaactcaggctggcttttcagatctttcataatatttccccacactacttagccaatcttatctcctactaacttctaaatgttaactctactcctgccaacttggtctcttcattgcttcccagatacgttgtctcacctgtatgcatttgtacatggcgtttgcattttctggaactccctccctaaatccttctatacatttttccaaaatatatcctccttccatgaagtattctgtaacccttctgatgaactcatcacttgcccttgttcttctaaacattccttacacacaaacaattcattttgacgttaccttgcacactcattgccagacgttgccacctgttttatatgtctgtcttctgaacaaaacaaattccctgttggcaaggacggtggtataaaccacctttgtatccttcaagaagcccaacacattgctgagtatattgcaggcctctaataaatgctttaaattgaaacgtggtaatgatgttttagaaagaatgagaatgaccatttgtgttttcttctctacctccagtcaagtatcatcacgtgggcaaactgctgaaggagggggaggagcccactgtgtactcagatgaggaagaaccaaaagatgagagtgcccggaaaaatgattaaagcattcagtggaagtatatctatttttgtattttgcaaaatcatttgtaacagtccactctgtctttaaaacatagtgattacaatatttagaaagttttgagcacttgctataagttttttaattaacatcactagtgacactaataaaattaacttcttagaatgcatgatgtgtttgtgtgtcacaaatccagaaagtgaactgcagtgctgtaatacacatgttaatactgtttttcttctatctgtagttagtacaggatgaatttaaatgtgtttttcctgagagacaaggaagacttgggtatttcccaaaacaggtaaaaatcttaaatgtgcaccaagagcaaaggatcaacttttagtcatgatgttctgtaaagacaacaaatccctttttttttctcaattgacttaactgcatgatttctgttttatctacctctaaagcaaatctgcagtgttccaaagactttggtatggattaagcgctgtccagtaacaaaatgaaatctcaaaacagagctcagctgcaaaaaagcatattttctgtgtttctggactgcactgttgtccttgccctcacatagacactcagacaccctcacaaacacagtagtctatagttaggattaaaataggatctgaacattcaaaagaaagctttggaaaaaaagagctggctggcctaaaaacctaaatatatgatgaagattgtaggactgtcttcccaagccccatgttcatggtggggcaatggttatttggttattttactcaattggttactctcatttgaaatgagggagggacatacagaataggaacaggtgtttgctctcctaagagccttcatgcacacccctgaaccacgaggaaacagtacagtcgctagtcaagtggtttttaaagtaaagtatattcataaggtaacagttattctgttgttataaaactatacccactgcaaaagtagtagtcaagtgtctaggtctttgatattgctcttttggttaacactaagcttaagtagactatacagttgtatgaatttgtaaaagtatatgaacacctagtgagatttcaaacttgtaattgtggttaaatagtcattgtattttcttgtgaactgtgttttatgattttacctcaaatcagaaaacaaaatgatgtgctttggtcagttaataaaaatggttttacccactatagtgtggtgacttatttaaatttttttaaaaaccttattctagggaatctgattcagacattttactttggcttaaaattcagtttcatttttgagtgcagagtttttgtattccaaaagaaacaaggggcaaaatttcatggagaccccacaccaaaaaccaaataccagcttgtcctgtttaagaaatagtga

SEQ ID NO: 138716 - DNA, 1089 bp, Homo sapiens
gttaattaagaaggtggttacaatattttagttgtattttactccttactaagccattcaattaaaaagtacaggataagttatcttcctcatttagggcctacccaccaaaaaggttgactctttataagacatatacaagtctagggttatacaaaatgtaaacataaaaccagtatttttactttcttctaagtcccaggatggtatttagcaaaaaaaaaaaaaaaaaaaagacaaaaatgttatatagaaatagcaccggttctattacacataaaaattgcacatgctgtattctgcaatttatttttatgtctgactactgagcagcaaactgttttcatgtctaaaaactctgcaaagaaaaatcaagtgacagaacacagtgagatttttttcaaaagcatagctgcttctcattacaaactcataatattctttgttttaatggcatgacacatgaaaaattaagaggcaggttttcgtcaaagaaaaataatacctggttactgaaagttgcctgacaaaatacaagctgttagcagttcaaaaggctactctggacaacagtactttgaacattaacattcaaggcacttgccccataagcaatgtttttcagatttgacaagccaaatctagttttgatggaagagtcactggcttgaaagtggaattgaacacaagggagccaacaaatcatccactggttattatcttattaataataaacatcatctgctatggtacattcatttctgacttcttgcatgtactaacatagctctatgattagaagagatcgatgaaacaacttgtggctcttccttcagataaataagcttttgtagccctttcacatacccgtttgctcaaaaggctggttatatgcacacattgtgatattctgggcaaccacaatgactggcattctacctggctctatcagctggtacttttctacagaatgtcaaattaagagtgtttgaatgaatcatgtcacatcaaagtgttgccctttactgcttctgtggattaaaaatgactttttcctgttgctgacagtctctaatctcattaatgtct

SEQ ID NO: 138717 - DNA, 1135 bp, Homo sapiens
gagcacccaccaggagaaaattaatcttattactatgtttaaatactcaaagagttgtctttttcaagacaaagtcttggaagaagaatctaaaagtggtccagattgtcctttgaggtttaaatggatagtatttaaacccattagcagagttgttgttttttttttaagaaccccatgtctttccattttagaaaaacagcaagattgaagtaatataaccactggaatttgcaaaaggaaatattgaaaaattgtggggcaccaatgatgtcacttgaaaaaagatgctgtgactattccacttcaggttatgtaaccctttcactcagggctggattacatcagtttgtaaagtcactgaatatcccccaaactgaactttattaaacagtaacaagtgcctctcttctcaatcctcagtgatgccatcaagttttcaaaaagagtaaagagaaaagcctatagttttgtagctagggaaaaatgtatatgtgtaggatttgtaaactctcaacataagcaattgatctttttacctactagtttttgacttcataaatgtttttaaattgaaatattttatggattcttaaagacttacatcttagtgcagtgcatgttttatagaaagctccgctgattcattctgccttaccttgcatttaggacctcaggggcaatcgattaccttttttttctccaacaaaactatgcctgacctggtaattgaagacattaatgagattagagactgtcagcaacaggaaaaagtcatttttaatccacagaagcagtaaagggcaacactttgatgtgacatgattcattcaaacactcttaatttgacattctgtagaaaagtaccagctgatagagccaggtagaatgccagtcattgtggttgcccagaatatcacaatgtgtgcatataaccagccttttgagcaaacgggtatgtgaaagggctacaaaagcttatttatctgaaggaagagccacaagttgtttcatcgatctcttctaatcatagagctatgttagtacatgcaagaagtcagaaatgaatgtaccatagcagatgatgtttattattaataagataataaccagtggatgatttgttggctccctt

SEQ ID NO: 138718 - DNA, 1050 bp, Homo sapiens
aagagtacaaaggacttcattcaattggagggtgaggctgaaacccgaagtttggttcagatcctgaaggcaaagttacatgggaagattatcaagctaaatggtttgaaaaaacacttaaaagtagtggctacagatgcccagggagaatgggagcacttccccaaggaaaaagagccctcgttgagtgatggggctgaagagcaggagaagagcccagattccatatgttttgaagagttgccctgtaaatggtttgcacctaaatgttctagcaaagagaagccatatgaagagatcctttgggtagtctttgaaagttttgggaagatcaagaatgtggatatccttatgcttggcccctacagagaagtgatgactgacaggagctttgggggttttagctttggcttacagacatttgaggcattcatacagtaacaagaggcaactgactttgtaaaagccatggagtccctttgaagaatgaaactgatgcttaaaggaaatgatgggaaagctctggcatgtaacattaaggtaagaagtagccagagtttcttttattttccactgttcaggtgatcctgaataaaagctggaaggaagcatctagaataaattttcttagaccctaccaggctctgatcaataactaatatataaagacttttattatttttaataaatggatgtttaggaagaaaaaaatcctgatttgaacactcattcttgtgctatcaggcatgctgccagctatgactttaaagtgatggttcttataatctgaggttctgtctcaactacttgagggcattaaagaattcttcatggcccctatggaattatctcatatgcttattatatttgacaagttgctgagagagaggaagagaggaatacatgcagtttgaaaccacatggaggccaggtgtggtggctcacgcctgtaatcccagcattttgggaggctgaggcgggtggattgcttgaggtcaggagttcgagactggcctggccaacacggcaaaaccctgtctctactaaaaa

SEQ ID NO: 138719 - DNA, 1053 bp, Homo sapiens
atttaatttttattgacacattgtaattgtacagaatttcgagagaaactctctataggcatgaaaaatgaggaattgtgttgaccatatcaatatctggaattgctaataaaacaggtgcaaaaatcagatcatgatggtatatacaatggtgtaaatcttacatgctgttcatgctgaatattgttaatatacagttgtcttaattttaaaataatttcattcgcttttgactttgtacctttttctctctggcactattccctggttaggatgccataacttcattttggtccactgtgaagagttcaagtgaattgtggcttctccagtctttcttcccttgatcacattttcagcacgaggtattggataatatcctattctgtgggacttgtattcaaataagtttaccttgggatttttaaaaggttgggaagtactgttactctcaaaaactgtgtaatagtgcaaagcagggtcccgtgtgaaggttgcttttgacctgtaggtggcgactggtgggcaggaattttgctggtaattttcagattgtggaaatacaactgagaagcaaaacactggcaacctcatgatacgcatttcccacaaataatactgattattcaatgatggaggcaaaagtatggaagatactcagccacattcctttaattccctgatagctttttttttttttcatgagaagagaaagcagtgagtcttcttcagtagcattgtttattaatccaaggtataaagcagcattcctggctggaggtgtctggagagaggtgttcttcaataaaaatgttcctggtgcagaagaaggggcaaaagaccaaaggactggtcagataggtctgctgactgctctgtgcaggtttttaaaaatagcttcttcccttgttatcttggaatgactcctatacacactagcttagagttagttatgtgaatgcatttgcacagaaaggccaacacaagacttttcttcaggctaatttattttctattagcctcagaaacactcagaacactttgcttccacaa

SEQ ID NO: 138720 - DNA, 1031 bp, Homo sapiens
gagatggagagaacaagggtaatagggagaagggtaaaaagctgagttgaaagaggtgggcgggggccatgttttgaaggtaagtagtttggatttcattcaaaacatgatgagatgctgctggagggttttgaacagaggagtgacatgatctgatttaggtttttaaaaatatgacattggctgttgtgtagagtagactctgtaggggcaaggatggaagaagaaggaccagttaggaggctgttgcagtaatccaggtgagagatcacagtggcctggactggggggtagcagcgaagatggagatgaatttgggatttgtggtaaaggtggagtcaaaaagacttttggaaggattaactcctaggttttgagcctaagcgcctgggtgcagggtggctctacttagggagctgggaatcactgggaatcaggggagcaagtgtgatgtggaggacaggtttaggagatgcaaattaagggctctgatgcacttgttaggttgagatgccaatgatacattcaactggagacattgaataggcagttgaatatcaatataaaagttggctggaactacagcctacataaaattaaatgcaaattaaagctgctttaagttgtcattttatactaataaaggtaacagaaataaaaatgataatgatccagtgtgatcaggactgcaggggaatcaagtatgttaataatgctgatggcctaataaattggcttttaaaaaatatttacataagacctggaacggtggttcacacctgtaatcccagcactttgggaggccaaggcgggcgaatcacttgaagtcaggagttcgagacaagcctggccaacatggcgaaacctcatctccaccaaaaaaatacaaaaattacccgagcgtggtggcatgtgcctgtaatcccagctactctggagactgaggcatgagaatcacctgaacccgggaggcagaggctgcagtgagctgagatcatgcccctgcactccagcctgtgaaacagagtgag

SEQ ID NO: 138721 - DNA, 1044 bp, Homo sapiens
ctgggttcaaatgattctcctgcctcagcctcccgagtagctgggattaaaggtgcacgccactacaccctgctaatttttgtgttgttggtagagatggggtttcaccatgttggccagggtggtctcgaactcctgacctcaaatgattcacctgcctcagcctcccaaagtgctgggattacaggcgtgagccactgcacctggccacatcattttatttaatcccacctgtaaggtaggcactattatcatcttctgaagctcaaagaggttaggtagcatgcccaaggatgtcaccaagctggtcagtggcagaggcgggatttgaacccagatctgcttgacaccagacctggagctcaaaagcattttggtttttactgtcacagagaaggttgcataaaagaggtgaaatggagcaaggttttgaagggtgagtaggctttagatgaggagatgggatatttggctgaggggatcaacatctttaaaggaactcaaggaagactggcccaactagaatgggggatggacacacgggtgtggtgaaaatagggctggcaaggtgggtaggatcatgttttggagacctttgaagggaaactgttacctgaagcagtaagaagtgggggatgttgagaattttggggcaaggaagagcatggcaaaggcagtatcagtcacctggtgtgaccagcatgtgcctctctcatcctcattctcatttctcattcttgagaaccttacccaatggtagcacatttagacattgtttttggatttcctgaacccctacagagtagcagacatgtgcaaccaaatacattcctgggtccagtgtgcagaaggaacacgctaggggccctgggtcaaactcagccttagatgagtgtgctgcggcctgcacaggatttgaaaaagcaattgaattagtggtcaatgttgaaaaagcaaaagaactcagtaaggatcaggatttccagcttatcttgaaatgctggaaggtctggtctgcatttcacttgtggagggcaaagctgt

SEQ ID NO: 138722 - DNA, 1033 bp, Homo sapiens
gagcttatgtttggctgcactggctgccaacctgttaggttgaagtattggcagttataattacacatatccagggtgtgtgttgtatctgtgctggctgaaaggaaggggttgctgcaattcaccagtgtatccagtctcactggaaaaagcttctgtgcatgtatgtgtgggggtgggaggaagaacagaaaagggaacagtgccgccctagcaaatcaaaagtttaagatgcatggactgagatgacatcattggcggattatcagggttgcctgccctgactctgagattctaaggggaacaattgataggacttatctctgtatcagatgggagaagtctgcgaaaaaaggacttcctatggttcttctttttaattgtgtatatttgatattgagactctataaaagaaactgatataaaatacggctcctcttcctagttcatcaagtcattcagtgaattaagggcctgtttcctctccgcttgcccctaccagtcatttccttgtcagaagtgttgaactcccttaggctctatgctgaggactaacacagggtctgatacattgtagaccttcaataaatgagtagtgaattaactatgccctagaagtgaccaagtgggatggggaataagagtgggacaaggagaatgaatggtatttctttgggcatttcaaactccaccttctaggtggttccagcttgctgcagaccgcccctccagtcaaaaatttctttttttttttttggaagaagtattgctctgtcgcccaagttggagtgcagtgacgcaatctcggctcactgcaacctccacctcccgggttcaagcgattctcctgcctcagccttccgagtagctgggattacaggtgcacgccaccatgcctggctaatttttgtattttcagtagagacggggtttcactatgttgaccaggctggtctcgaattcctgacctcgtgatccacctgccttggccttccaaagtgctgggattacaggcgtgagccaccacgcccag

SEQ ID NO: 138723 - DNA, 1031 bp, Homo sapiens
tttcaaatagatgcaaagtcatgatggttgtaaaaaaaaaaaaaaaatccaaagaggtaattgcactgttttcacaaaataggatcaacatgtaattatgaataacaatataaatgtcatccaaagatataggaagtgaacttttagggtttcagtgaaagtgttattttgcaggggttaataaacatactaatactttgtccaccctatgttaaaaaaaaaattcacccccaagacagaactgcaggctgcttttaaatgcaaacatggcattgggcttctctggccattagatgtcactgcagtaaatggagagtagctgagcatcacctgattggagcctgaagttcggtgatctctgtccagttaacaacttcataatccctgcttgaaatccatctttggtttggagaataagaggcctagaaaccacaggctaatgctaaacttgttggttttgttgttactgttacttgtcctacaaagcacacactccaaattcaccaagaagagagggctttaataacagtctgtcctcgctggagcaggcagggtttgccagcagaataagtaacgagggacctttgcagggccactgggctgctctgacctgagcacacttaatggcaacatttgcattccattggctttccccattgcactgcctgtcatgaagcaaatcaatggcaggtgtctgttggataacgagctacacagggaatttttctcgatccctgcactgactggcccctttgtctggatgtttctttctcttaatatgcttttctctagacacacacagcccatttaatggcacatcaggttggaactcttttgaacataatgacagtaatcagaagtcttgtttaaccagctgagcccttccttcaccatgcttacactcattttatccctttttccttttcttgccttggctcctggctggcatgctagagaatggagaggtaaataaattatgcatgtgcatgtcttgatagaatggcttctggtgggaaggggggtgggtcagg

SEQ ID NO: 138724 - DNA, 1028 bp, Homo sapiens
tcctcccgggttcgagcagttctccagcttcagcctcccgagtagctgggattacaggcgcctgccaccatgcctggctaatttttgtatttgtagtagagacagggtttcaccatgttggccaggctggtctcgaactcctgaccttaggtgatctgcccacctctgcctcccaaagtgctgggattacaggtgtgagccaccacaccctgcccttccacaagtattattaaatagatagctaaactcttgcagttgtcatgcacagaaatgttttctgagctgcagttttgattttttcttcattaaattaagtggggaaaataatacgcctgatttttctaatttcagaagaactctaaaactcttgttctgtttctaaaataaacttccagctaatttcattttctttggattatgaagagagagttctgcctttctgctttatggctgacagtgagcaccacactggactaagtacttgagaaggattataaagatgtgtgatgcaatgttgactcaggaggaatttatggtcttgaggaacaaatcatacctacatatatgaaatgactatgattacaaagcaaatacaagcaaaggcatgataatgtagtatgaactgttcataagattgccaagaagctctatacaaacttagtgaataaaaaactaaagggatcatcacatgggagagagactagtgatcaacagggatttggggaggttgtgagtctttttttttttttttttttgaaacagagtctcgttctgttgcccagcctggagtgcagagatgcaatcttggcttactgcaacctccacctcctggttcaagtgattctcgtgcctcagcctcctgagtggctgggactacaggcgcctgccaccatgcccagctaatgtttgtattttcttggtagagacggggtttcaccatgttggccaggctggtcttgaactcgtgacctcaggtgatccacctgcctcagcctcccaaagtgctgggattacaggcatgacccacc

SEQ ID NO: 138725 - DNA, 2596 bp, Homo sapiens
ctctagagggcgctcctgggctagcgtgtagggctggcggcggcggcgctcgggtcacctctgggagcggagtgggggcggagcgagacggaagcagctcaggagacttgaggcgtaggctgcggtccccaaggtgaccgcgccctatgtgggactcgccctaatgcctctgaacctgggtttgaggtaatgacctttctcctaggtctgaaggtcacgggtccgctggaggatgccccctctccactcagaggggtggaggcttaatgctactggtgcagatcacctcttcccctgtgacagcctcagagggttgggagggtccagccagtatgatatacgaagactagatttgagagaggggagcctaccttaaagggcattgatcgagatggcataagctcttctctttcccttccccatggttataactgtccctgttggcttccttcctgtctgttaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggctctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggtaagtttgctgtgggctttaacgttgtgttcttaggagacagtttaaaagagcattgtaccaacctaacagtccaagagctaaagagttgtttttttaattgctaaaggaagccaagatcatccaatgcaacccttgtgtacagatgacgtgtttaggggatgtggggaaaggaagtcagtaaaactctgctttttggtaaaagcatctctttcctattcccaggaatgcttccggatcccaagaacactcacatcgtcatcagctggatgatcgcacagactgtcactgctgttgccgggttgacttcctatccatttgacactgttcgccgccgcatgatgatgcagtcagggcgcaaaggaagtaagttccacttgagcagaagataaagttgtagtcgtggggcaatctgctgccacaaactggtgatacatacctttaaaatggctgtctgtccaagtcaagggatggggttgatagcatctgtgtctgttccacaactgcctttgagctggcccttcagatgcctatgaatgagggtgcttaaatggtgttagaggttaagaccaatgggtagtctgtattcctgtggtcatagcattaatatttcagtgttgcccatgctaatgtgtgaatgttggatttaaagctgacgttcttagaggtggggctctgctttatttagcctagtgaatcttaggatttttcatcggccttcagtcactaactccatgtctttattctttgcagctgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaattttgtctgcagtatattttcatataaaaatgcatatttgagtgctacattcgaataaatactacctttttagtgaatgctacatttttaataaatgctacagtatctccggagatgaagaactgtctttttaaaaccaattgtcagcagtccgcttaacagaataacttggttgtgccacccacaaacatttccaacacattagcaaaggaattcaggcccagtgcatccaaaaaacattgttccattgcctatggatgatcatagctgaatgagctttctccaagaaatactgtgaacccaccttctctagtcctatggttattaatcatgagccatgagctgaattatccactttaaaatggttacgtttgttgcatgaatatcacctcatttaaacttttagaatcaataccaatttcatccagttgccttcattttcacctggctcaagccattttttttttttttttt

SEQ ID NO: 138726 - DNA, 1112 bp, Homo sapiens
atacaagacaagcacaaaagcaccacccatgcctctgagaacattggaccatgcacccttgaaaaaagctttgcctccttcatcacgagcaatcttccgccagcagtcaagcgtgcctgtgtacatgatgtcagctgcaaagaataaagacatggagttagtgactgaaggccgatgaaaaatcctaagattcactaggctaaataaagcagagccccacctctaagaacgtcagctttaaatccaacattcacacattagcatgggcaacactgaaatattaatgctatgaccacaggaatacagactacccattggtcttaacctctaacaccatttaagcaccctcattcataggcatctgaagggccagctcaaaggcagttgtggaacagacacagatgctatcaaccccatcccttgacttggacagacagccattttaaaggtatgtatcaccagtttgtggcagcagattgccccacgactacaactttatcttctgctcaagtggaacttacttcctttgcgccctgactgcatcatcatgcggcggcgaacagtgtcaaatggataggaagtcaacccggcaacagcagtgacagtctgtgcgatcatccagctgatgacgatgtgagtgttcttgggatccggaagcattcctgggaataggaaagagatgcttttaccaaaaagcagagttttactgacttcctttccccacatcccctaaacacgtcatctgtacacaagggttgcattggatgatcttggcttcctttagcaattaaaaaaacaactctttagctcttggactgttaggttggtacaatgctcttttaaactgtctcctaagaacacaacgttaaagcccacagcaaacttaccctttgcagtgtcatagataccgaagtaggcggctcggtagatgataataccctgcacagacacgttaaagccttggtacaggcccttaatcccatcagatttgtagatcttaaccaggcagtcaccgaggcctcggaattccctttcagctccagctttacccacatcagctgctagacgggtacgggcaaaatcaagagggtacacaaaacacagggatgtgg

SEQ ID NO: 138727 - DNA, 1050 bp, Homo sapiens
attctcctgcctcagcctcccgagtagctgggactacgggtgcccgccaccacgcccggctaatattttttgtatttttagtagagacggggtttcaccgtgttagccaggatgatcttgatctgacgttgtgatctgcctgccttggcctcccaaagtgctgggattacaggcgtgagccaccgtgcctggccgagatggagtttctctctttcgcccaggctggagtgcaatgacacaatcttggctcactgcaacctcccccttccagtttcaagcgattctgcctcagccttttgagtaactgggattacaggcgcctctcaccatgccgggctaatttttgtatttttagtagagacggggtttcaccatgttggccaggctggtctcgaactcctaacctcatgatctgcccatttcggcctcccaaagtactgagattacagatgtgagtcaccacgcctggcctcaagccatttttaattccattcagagtagaggattagagctggcacagttacatagtgctgagattgcagtgctgttaaagattatgaagagggccagacattggccacgacctcaaaactaaccttacaaagaggaaatagcatctgccttttgcttcatgctaataagcccagtcaatggagggcatttatgtttattttcaataaacccttatttggaatccatgtgacagtgtttggactttctgtatctcttgattagggctcaaatccagtggattttgccatgagatttgtactaagaatgcagcattatgtctgtcaagccacaactttaaaaatgatagaacgggtgctccatgtgtacatgtaaagctcattcttgaggaatatcccacacactggcatgtataagagctattcacagagaggtctgcatggcatggatgaatgcccaaggatcccagagtttatgtttgtcctctggccaggcacctgaatcgtagtatagcttagttattaagaattctgttctggtatcaaagaggcctgggctgaagttctggactctgatgtt

SEQ ID NO: 138728 - DNA, 1065 bp, Homo sapiens
cttcactcctgagcccagtgagaccacgaggctaccaggaggagcaaacaactccagacgcgctgccttaagagctgtaacagtcaccgcgagagtctgcagcttcactcctgagccagcgagaccacgaacccaccagaaggataaaacttcgaacacatctgagcatcagaagggacagactccagacgcgccaccttaagagctgtaacactcaccgcgagggtctgcggcttcattcttgaagtcagtgagaccaagaacccaccaattccggacacatcaagaggctgaggcaggagaatcgcttgaacccaggaggcagaggttgcagtgagccaagactgcgccattgcactccagcctgggcaacagaacgagactctgtctcaaaaacaacaacaaaaaacaagttctgttatttgctttctctgccctacctgtcctttcatccccattgccatcaccctagcctgtcactaatccctttgctgttgcaacaactgcgatacctgtgtctcctcctcctccacttcaacccacacctcacaccacatctgtgttgattgtctaacccattgtccacatctgtgttcatcgtccaacacccaccctactttgtgtgcgaagctccccattgcctacacggataaaaggttcaaggccccaaacttcctctcagtcaacccgtattagctgatgacctactgtatgcaaagcactcctccgaaatctgcttcagcctaaggggtgtgatcacaatggccaccaattgtccttgagggttgcagcaggctctttactcacattgtatcatgtaatctgtttttttggagagggagtcttgctctgtcgcccaggctggtgtgcagtggtgcgatctcggctcactgcaacttccacctcctgggttcaagcgattctcctgtctcagcctcttgagtagctgggactacaggcatgcaccaccacgcccagctaatttttgttgttgctgctgctgttgtttgtttttttgagatggagtttccctctgtcgcccaggctggggtgcagtggtgtgat

SEQ ID NO: 138729 - DNA, 1059 bp, Homo sapiens
gaaggagaataacttgtttatattaggcaaggccccagtagcttctttgtaaatttcagtctggagaaaataaagccagagctgcaagtccaaacaggtaaaaaaaaaaaaaaaaaaattttttttttttttttgagacggagtctcacactcttgcctgggctggagtgcaatggcgcaatctcagctcactgtaacctctgcctcccagcttcaagcgattctccttgcctcagcctctcaagtagctgggattacaggcacccgccacaacgcccagctaattttttttgtaattttagtagagacgaggtttcaccatgttggccaggctagtctcgaactcctgacctcgtgatccgcctgcctcggcctcccaaagtgctgggattagaggcatgagccaccgcgcttggccccaggtaaaattttgataagctcatgaaaatttcaactagagagttcaggcacccatggctgggatgagggcaacaaatctggagcaacaaacatgcaaccaacaagctttttttgacagcatacttttgtttggcactcctctacgcactgggatacaaatatgagtaagaatgctaccacctaaaataatagatgcctggataggcatagcttatctctggaaggtaacaccagaatgtggtcatggagattacctgtgggtggcgagggaacaggggtgggagggaaactaacttgttactgtaaaccctttataccttgtcaatttggtatccgaggatatattaccaatatattacccattcaaaagataaatgtggtatcagggagacacaaatacgtaaatgtgtaaatagagaagtaaatagcagcatcagctcacaaaagcatgttcacagtgctagagttattgacaacaatggaggaaccatgatataaagactgaatttactagcccaggcatgatggctcacgcctgtaatcccagcactttggaggcccaggccggcagatcgcctgaggtcaggagttcgagaccagcctggccaacatggagaaaccctgtctctactaaaaata

SEQ ID NO: 138730 - DNA, 1050 bp, Homo sapiens
ctcaagtgatctgcccacttcggcttcccaaagtgctgggattacaggtgtgagccaccgcgcccggccgagatggagctttctctcggaagtgtttccagattccccaaatgtcagttagttaaacattcttccttctttgctcccaaatctcagtctgctgacccctcttaacactcttgtcacactatattgtaattcttacttctctgcctccttcactgggatataagctccataagggtaggattttttctctcttcttctctgctgtgtatcccttgctcctagtacagtgcctggcccacaatatctgttcagcaaatgtcaagtcaataaatagtttggtcttatgttacagcttgttttaattccactttattaaactaataaactaattccatttatatatgtgtgactggcttctctggcagaggacaaagtccttaagggaaaggactatgcttaagtcaactttgcatcctcttcccctccccttggtacttggtacaggaccttgttcataacagacactcaacaaatgttcactgaatgagtctgtatgtgtatattggttgttaagggtacactttttttttttcctttccatagaactgcacaaaactgtttgtgagcaagatctgagaagcaagcgatgtgctttttgaacgcctgctgttctggcacacctgggcccaaccctgactgagcccgaggcacaggaaggaaatgcagttgcaatgtgattagggtcatgagggtttctgtaaccgagggacgccaaaacctgagtgagtctctgagggcgatcaagggttgcccaggacctatcctgaagctctgaagccttcctagatgacagtctctgactcctcctatggaatccctcataggagcccctggccgggctagatccctaggataggtgagctgactttggaagtctttctggtgcaatgtcacttggaagtcaagctgtttgtgttgggataatgtagaaagaagaagcctgaagagaaggcctaggaggggctgggctgacaatccagc

SEQ ID NO: 138731 - DNA, 1045 bp, Homo sapiens
ggctgaggcacgaaaatcacttgaacccgggaggcagaggttgcagtgagcagaggtcatgccactgcactccagcctgggtgacagagcaagactccatctcaaaataaaataaaataataagatatatatatttctatatatttctatatatatatttctatatatagaaatatatatatttttatatatatatatagcatccccaagatttagaatcagacagacctgggtttgaatcttgatttttcttcttattaactgtgacctcaggcaagtggcttaacttctctaggcctcagtctcctcattaatagaatggggaataataatacctgcttttctggctgttctgaggatttattcactcatttgaaagatagtggcatgcctgtcctacagttgttactaggttcaggggatacaagagattcaacgcctggcacatagtaagtgctgaattaatgataacttgtttttgaaggtcatgccacgaatttggactcaaaatagcaggcagttgaaagcattctgaaaagagaagtagtaagaaaaaaacactactttttttttttctttctcaggcagggtctcactgttgcccaggctgagtgcaatggcacaatcatagctcactgcagcttcgacctcttgggttcaagcagtcctcctgcctcagccttccaaagtgctgggattacaggcgtgagccaccatgctcagcaggaaaacaatattgaagaggcttcacccctacctgcagtgtagaggcaggattgaaaaatgccagccttatcattttcatagagttgttctgaacatcataaaatagggcagagcaagaggcctaagactaataaatagtcgggagttgaacccatattgcaactggggacagggactgctcctaaaatcatagggccacagtctgcctctcccctgggaagcagcaaggggaaggaggggctgagaagaagccttctgtctgctcactggaagctgaggggcttcattttgccgatcacctggcctgtcttcgggcagt

SEQ ID NO: 138732 - DNA, 1170 bp, Homo sapiens
tactatatagagagagtatatatatatatatatttttttttcttttttttttgtagggacagggtttctccatgttgcccatgctggtcttaaactccaggcctcaaatgatcctccctcctcagcctcccacagtgctgggattacaggcatgagccacggtgcctggtctgaaagtgttttctttcagaaggaccagagggaacagatggccagagcccatcatggctccgtcatgctgtctccaaggacaaatggaatattctggaggaagggtggactgtgtaagctctacaggtcaattctcaatctcagcttgttcctgccagctcagcccttattcccaattgaggagaaagaggaggttcaaggaatatcctgctttttttccaggagtttcagggctgggcatggggtagggactcaagtcatgcctttggaatggagctggaggagtgtgagttaataggcactcttgtgggggctctcctctccctttccccatggggccagtcaggacttggagggcttctggctgtggaactggtttggttcccctgcttcttggtaccattcccagtctccacttgttcattcattctgacctcaactcctactccagtccctatcagctcactctgctccagccacagtgatctcctccctggccctcagacatgccaggcacattcctgccttgacattttttcctcaggtatctgcaaacggcccaccctcacttccttcaggtcttgattttgtctgagaaaatgtcattttctcagaggattttgctgaccattgtatctaaaatttcatcgcctcctcatacttcctatccccctctcctcctatagtttttcgctaaaaccctatataaatatttgctcattttgctcattgtctggtgctcccactataagctaaaagtttagtggggacagggattttttctgttgttgttcactgctataccccagagtctagtagagttccgggccgggcgttgtggctcacgcttgtaatcccagcactttgggaggccgaggcgggtggatcacttgaggtcagcagttcgagaccagcctggccaacatggtgaaaccccgtctctactaaacatacaaaaaattagccaggtgtggtggcacatgcttgtagtcccagcta

SEQ ID NO: 138733 - DNA, 1004 bp, Homo sapiens
agaagcaagtgttttacatgactcgaggtccagttaagaaaacagaaaacaactttgggaggctgaggcaggtggatcacctgaggtcgggagttcgagaccagcctgaccaacgtggagaaaccccgtctctactgaaaatacaaaattagccgggcgtggtggtgcatgcttgtgatcccagctactcgggaggatgaggcaggagaattgcttgaacccgagaggcggaggttgtggtgagccaagatcacaccattgcacttcagcctgggcaacaagagcgaacaaccgttttaaaaaagaaaaaaagaaaacaaaacgtattcagagttgtaaacagaatttaacatgaggaactggtactcaggggatagaagaccttagaatcccaggaagggatgatgaattgatccagagatttagcaacagcaggaagctacttcacctctagggctggagggacaaaagcagaaggtggtattacccaagtccgggatcaaggaccacccagcagaagcaggaacaccagcccagcaggagcttggtccatggagggagtgactatctagtgggagccacagaagagataacagtctatgctggagatgacgctcaaaacagagagaaagggaggaaataccctggcttcttcccttctcttgctttccagtcttctgccaaagattcccattcacaggccaaacctctcaggaagtcaggagggaaaggagcctgggaaatgttgtctgctgcacatagcagagcaggggaagagtggaatggggccaggcacggtggctcacgcctgtaatcccagcaacttcgggaggctgaggcaggtggatcacttgaggtcaggagtttgagaagcggggaatgagtctgagagcaaatagacaaatgaccagcctgtgtttaaaggaggaggaaatgatcatctgccaaatgccacagacaagatgaggacttggaaatgaccactgcatttagcaatggggagg

SEQ ID NO: 138734 - DNA, 1022 bp, Homo sapiens
ctgcctcagcctcctgagtagctgggactacaggtgtatgctaccacgcctggctaatttttgtatttttagtagagacggagtttcaccatattggccaggctggtctcgaattgacctcaagtgatccacccacctcagcctcccaaagtgctgggattacaggtgtgagccactgctcccggcctccagtatacattttagaattggcttgttggtatctccagtattctttctgggattttgattgggattgtgtaaaatcgaaaaatcacgttggggagaattgacatcttaataatattacatcttccaacccatgagcaaagtgtatctttccactttccatttgtttagatctttgatttctttcatcagtgttttgttatttttttcgtgtataggtcctgcagatattttgtttaaatttatacctaagtacttcatttttccggtgctattgtagatcttaccttcttttaaaactataacatctgtcctacaaactctcaatttagaatcagtcctacaatatgttttgtctgatgtcttacccaaatagttgagtgttcatgtcttgtcaatgagtggatatttggcactgtgaatttatggttccagtgtcagatgggttcttaccacagctagtcaatcctaatgtatgttttgggtcagcaactctcctgtttccctaaggaacagtttacagctgctttcttcaagcctctccctgcaagctctctctcttggtagatgaccagagagggatctccaaagcaccagcaacttaagggcacacttagttgtgtctgcctccatctttttctctttcaaatctcagaggaagagatccccctcttcctacttaaggctaatctacttttagtcattcaactagtatacattgagtatctattatatgccagatattgcactaggagctgggggcatagtagagaacaaagcagctcacattctgagggcaggggtgacagatgaacaagtgaacaagaaaattatct

SEQ ID NO: 138735 - DNA, 1056 bp, Homo sapiens
cagtttcttcatggtatcttgtaattttaatttgcatttccctaatggcagatggtgtggaacatactgttttcctttttttttttttttaaactgtggtaaaaaacacataaagtttaccatcttaacctttcttttttttctttttctttttttttttttttttgagacggagttttgctgtcatagcccaggccggagtgcaatggcgcaatctcggctcactgcaacctctgcctcccaggttcaagcgattctcctgcctcagcttcccaagtagctgggattacaggcgcctgccactatgcccggctagtttttgtatttttagtagagatgaggtttctccatgttggccaggctggtctcaaactcctgaccttgtgatctgcctgccttggcttcccaaagtgctgggattacaggcgtgagccaccgtgcctggcccatcttaaccatttttaattgtgtagttcagtagtgttaagtatatttgaattgttgtgatacagatttccagaactttttcatgttgtaaatctgaaactctatacctattaagtaacaactccccctttctctctccccacaacccctggtaacaccattctactttgtgtttttatgaatttgactactttagatatctcatgtaagtggaatgatacaacatttaactttttgtgactggcttatttcacttagcataatgtcctcaatgttgaatcattagaaaggaagaacaccttcctttctaaggctgagtaatgttcccttgtatgtctataccacattttgtttatccattcatccgtcaatggacatttgggttgcttccaccccttgctattgtggaatagtagcacaatgaacatgagtgtgcaaatatctctgagaccctgctttcaattctgatatatacccaaaagtgaaattgctggtagttctatttttaattttttgaggcacctccatacatactgttttccacagcacttgtaccattttacaatctttttttgtttgtttttgagacagagtctcactctgtcaccc

SEQ ID NO: 138736 - DNA, 2824 bp, Homo sapiens
ctggctaatttttgtatttttagtagagacgggttccaccatgttggccaggctggtctccaactcctgacctcaaatgatccacccacctaggcctcccaaagtgctgggattacaggagtgagccaccgtgcccagccttgccctgctttctaggagatggagttttctgaatttttctgtatttaggttttctgtactattttttgtccacttgatgcaaacttcttcagctgtgtagaaactttatgaatagatgagtgcttgagtgtctccagtctctaaagtggctgcttttattctttcttcaaagttaataacatgttgcaagatttttggacaaaatattatggtgtgtcataggaaaagcaccatgaattatatttaggtatagcaagtcagatcctttgaagtgactctgtctctgttcttagaagggttcttggaattggctgtggtttgaatctttctactgtcagaggagacccattaaaagccagaatctgcataaagctttctttacttcaaacactgaagctgtaggcgagccatcccgtatcgactttatactcaaagaaggaaaagccagattgcagtgagtgggtaggacagctcagatccaaatgaaagtagggtctcaagtaacccaagggtggccgggtacggtggctcacgcctgtaatcctagcagtttgggaggcagaggcgggcagattgcctgagctcaggagtttgagaccagcctgggcaacatggtgaaaccctgtctctactaaaatacaaaagaaattagccaggtgtggcggcatacccctgtagtcacggctacttgggaggcagaggcaggagaattgcttgaactcgggaggtggaggttgcagtgagctgagattgcaccactgtactccagcactccagcctgggcgacagagtgagactctgtctctacaaaaaaaaaaaaaaaaaaaagtaacccaagggagggagctaccctctagtcgggcagctgatactgcttccttgcatggatacatgggagggagacgttatagattaagaaatgatagcaagataaacaaaatgatttgttgggtatcttttactttacatttgttatttgcagaggagtgttgtatatatagatgttattttatgtcacactgcttcaatgatacctatatccatgtgtttgtatccatgtttttatccattcaactgtattaaaaggtgttgggacaggagttgtgttaaccttcttgtattatctacaaaaagttgcacttagtaggtgcccaaggcaggttcgtgaggtgctaccgggagatgatagtaggatagtagggcaggtttttttttgtttgtatgtttttgtttttgtttggtttgtttgtttgttttgctttttttctgatctccttatttgcaaggcaaagtaggttagatgtgagctagcaagaactgggaaaaagaggggtgggggtcccaggaaggcccaggatggggctgtgttaccttcttcccagttattttcctgtatccagtgaagtcttcgcaaccaattcttcctctctaccttgtttcccgtcctcattctgagagataattaaccgtcatgtggatgagaaaccataaccttacagttccttaacctcaactccagacagtgacctttacctttcctgcactttagccacaaactcccataccacagcctggatgtcatccactccacctctgaaatccagtactctgctctctgaccacaacctatccttgctactctcatgtgctcacttcctctaaacctattttattttgtttttagatttgaagggtgattattttattaacagtaataatgaaaaaatagtagtaagaatagcaacaataatactagctaccttttattgagcacttactatgtgttggatgccatggaaagcactttacaggtattatcttaatctaaacaacacgacatcctacgggacaggattaactgttaccatccttgttttagaaatgagtactccgaggctcagagagttttaagtttctcaagatcctatagcccagtaagcaataaagccaaaaatctgactctaaaacctgagctcttaactatgctgaactccctctatgaacttaaaacatatatgttattcagaacagattataatttcattttgaaaaataaagtgcaaagtcaagacagttgcatagaggaccccctgtagcaagtgtatggttacctttctacatattttctgaaatacttgtctttagatactaatcctaaaccatttcaacatctggttgaaattacacatgttgcttcatctataagactgtaaaacgtcattagcaccaagcaagcatatgcttttcattatgttttactcttttttttttttttttttttagagatggagtctcgctctgtcgcccagactggagtgcagtggcacgatctcggctcactgcaagctccgcctcccgggtttacgccattctcctgcctcagcctcccgagtagctgggactgcaggcacctgccaccatgcccggctaatttttgtatttttttttttagtagagacggggtttcactgtgttagccaggatggtctccatctcctgaccttgtgatccacctgcctcagcctcccaaagtgctgggattacaggtgtgagccaccacacctcatatttaaatagttattaaaataacatgatatgttagtatttagtttctctattttctttattaacttgtattttaacaggaaatacagcgttttgctgttggtatgaagagccatgt

SEQ ID NO: 138737 - DNA, 1200 bp, Homo sapiens
cccaactcgtggtttgtgagtctgtcctcagtagtagtagcaattacctttatggttcttcagtataacgatattgatggcaagatgtcatctgctgttttacatatgttttggttaaaacgtaaatgctactgaagaatcacttgaacccgggaggtggaggttgcagtgagccaagattgtgctactgcactccagcctgggcaacagagtcagtctctgtctcaaaacaaacaaacaaacaagcaatcaaacaaaataccctaagtgctcctggattactgaaaagatggagaatggaaaaggaacagagtcctgccattttagtcatgatttcatgatttgagtagtatacattatgacttaacgtctttgttgttattccttggtgagacttccggtttaaggatgctccttttttccttcagagggaagttgctgactcatatgcacagaatgccaaagtgattgaaaaacagctggagcgcaaaggcatgagcaagaggcgactgcaagagctggtgagtagcaaggggtagcaaggtgctggggccctatcatttggatgtcttggtctgaaagacctttcagcaggcagggaaatcttttaggaaatctgttgggaggttttagagtagttggctgccagttttataaccctggtctgtgactgtcagtataccctactctgtagtagtgaccccaggatctaggccttaaatgatgatacttgttatagccctaactaggatgatattttattttctgtattttatttttattttatttatttatttattttggagctggaatctcactttgtcgcccaggctggagtgccgtggcgtggtctcagctcactgcaacctccgcctcccgggttcaagggattctcctgcctcagcctcctgagtagctgggactacaggcacgtgccaccacacctggctaatttttgtatttttagtagagatggggtttcaccatgttggccaggctggtctcgaactcctgacctcaggtgatctgcccgcctcgggctcccaaagtactgggatttcaggcgtgagccaccacgccaggccaggatgatattttaatctgcttcttgtggtccaagatcaggagttaaaggtcagggtttctggacgttgtcccaggatgtaatggcacatgatagggctaccttggtagtaccag

SEQ ID NO: 138738 - DNA, 1107 bp, Homo sapiens
ggagatacctgacctgtatcaggggctccataaatgtttgttgcaggaagggaggaatgttgaaccaatgagttgacctatgaaatgaaaacttttttttttttttttttttgagacggagtttcactcttgttgcccaggctggagtgcaatggctcgctctcggctcaccgcaacctccgcctcccaggttcaagcaattctcctgcctcagcctcccgagtagctgagattataggcatgcaccactgcgcccggctaattttgtatttttagtagagacggggtttccccatgttgaggctggtctcgaactcctgacctcaggtgatccgcccgcctcagcctcccagagtgctgggattacaggcgtgagccaccgtgcccggcccccaaatgaaaacttttgaaagggcctcttagcgtttgaagaaatgggatagtaaggttgatacataatgagatttgttcatatctttttaacttccattttctgtgcagacctgaaggcattgaacgacagtacaggaagaaatgtgcaaagtaagtattaacaatgtgggtttctccaagcataggcaagtagaggcataatgtgttaggaaaataattatttggatacaactctccattatgtctttttttttttttttgagacagagtcttgctctgtcgcccaggctggagtgcagtggtgcaatctcaggtcaccttaacctctgcctcctgggtttaagcgattctcctgcctcagcctctctagtagctgggattacaggcacatgccaccatgcctggctaatttttgtattttagtagagacagggtttcaacatgttggtcaggctggtctcgaactcctgacctgagttcatccgcccacctcagcctccaaaactgctgggattacaggcctgagccacctcgtccgacccccattatgtctttatccttatcaactgccttcagacttcaactatgcacaaataccaatatgttccccaaagaggctagtcaaagttgtatctttgaccagctggccagaaaaatgaatttttttttttgagacagagtcttgctcttgttgcccaggctggagtgcagtgg

SEQ ID NO: 138739 - DNA, 1264 bp, Homo sapiens
cctcggcttaccgcaacctccacctcccagattcaagcaactctcttgcctcagcctccccagtagctgggatgacaggcgtgcgccaccacgcccagctaatttttgtatttttagtagagacgcagtttcaccatgtcggccaggctggtcttgaactcctggcctcaagtgattctccctccttggcctcccaaagtgctgggattacaggcataagccactgtgcccggcccctccattgccatttgatagccgtagtttgtttacaatttacaggtttgaatgagttcattcaacctgtaatcttgtggagcataccgtgtgccaggcactgagctaggtactggatctgtgaagatgaataaggtatgatttttaccattaaagagctcatgactttgagggaatgactcctattgtgataggaaaaaatactggtcttctgaacgaaaggaaaaacaggtgggagtgggtcatttgtcctgaatggtggccaggaaaggcttcaaaagatgatggcatttgtgtttagcctgaactaggatttcaccaagtagatgaagggaatgaagagcattccaggtggaaggaatatggaagcattaaaagcatcaaacatggtgtgctttagaaacctgaattgtcgtttgtgactggagcacaggttactttacaggaacggcatcatgcatactagggtgaggacagagtaaagtgctgaagtggacaagtttggccttaatctgtaggcaatgaagagccatctccgtttttttttttttgacggagtttcgctcttgttgcccaggctggagtgcaatggtgtgatcttggctcactgcaacctccgcctcccaggttcaagcgattctcctgcctcagcgtcctgagtagctgggatttcaggcacctgccaccacgcctggctaattttttgtatttttagtagagatgggatttcactatgttggccaggctggtctcgaacttctggcctcaggcgatccacctgcctctgcctcccaaagtgctgggattagaggggtgagccactgcgcccggcctatctctgttttttaagcaggggtgtgatgtggttagctctgttttagatttgggagtttggtatatatgggaaattgaaacctgggaagggataaaattacagagtgtggagcaagcagataggactgaatatttaaaaggcagacaaaagaattggaacagaaccagaagaacctggtgatgcagaaaataggag

SEQ ID NO: 138740 - DNA, 1023 bp, Homo sapiens
ctctcctccccgggcatagtgcgcgctttcatgaatgatctggtcacaaaacaaacaaaaacgaatagaaaaagaaaaaaagagaaaaagaaaaaaagccgaaaacttcccagggtttgccttagaattagcaggtggggatggaccccgttccaccacgagctcctccagcgcccggggctccggcgtaccctacgcctctgcgctcgcggccccgccccgggcctcccgtggggctttaatgacataagcaactttcctcgcgcaccccccgccccgtcttggtacggcctgtccggcgctcgacgttccacccccctctctctgctctcaggttggttcagcccccgtctacactggggtggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggtaaaccgaggggacggccgaggccgggggttgcgagctggggcacagggcgggtcccgaggcgcgccgggcggggagggctggggagcggccgggagcgggcgccagtgccggcctagggggacccctgtctgtcttcccgaaggttgcaggaggatcctccagccggagtcagcggggctccgtccgagaacaacataatggtgtggaacgcggtcattttcgggtgagtctgcgttcgtggcggtggcgagaaaactggggacgcgagcagcttcggtctgcgctccggggcgggccccccgcggaggccgagcgggtaggggaaaatgtttgggtctggctgggcctaggcgcctccccggagcctgtgcctcgattagctcagttcccgctgccagggggaaccgcttggggttctaggggggcggggcggggagtggtggcggt

SEQ ID NO: 138741 - DNA, 1406 bp, Homo sapiens
ggctaattttttgtatctttagtagagacggggtttcaccatgttggccaggctggtctcaaactcctgaccttgggatccacccgccttggcctcccaaagtgctgggactacaggcttgagccaccgcacccggcgagcactagttctttatacctgagctttaaatgtacagattaactgtgtttgctttagctctagtaggccttgttttcattggcttcttttttcctcgttttactctgttttatgctgggcacagctttattaatagtacatcactttgctggggattggctacctaaatatttcaagggtgcttctcttaagtggtatgaattgaaaaggtacttacagagtccattatctaccaggactgtcacctttgacattactggttctatttttgatgatgtgtatctccatcctagcattactgaaaggaattactcaggctgatttgttctgttgaacagtctgctaccgatggatgcttcctcaggtgtctggaacactgtggcctgtggttcccccacaaaaaaaattttagcttttttttttttttttttttttgagatggagttttgctcttgtcacccaggctggagtgcagtggcacgagctcagctcactgcagcctctgcctcccaggttcaagcaattcttctgcctcagcctcccaagtagctgggattgcaggcacctaccaccatgcccagctaatttttgtattttttagtaaagagggggtttcactatgttgggcaggctggtctcgaactcctgacctgaggtgatccgcccacctcggcctcccaaagtgctatgattacaggcatgagcagccgtgcccagccttaaccattttttgaataccctttatttatagttggggaatttacagttagagaaaagactgattagggataagtggcatagttgattttgctgtttccaatgtattatgttattaattaagaaccccaaaactacttttgcttctttgttgtaaaccgttcgttatggaagtttctggaacaaccaggtcctagttagagtgatgaaatcttaagacaagcaacacttaagggtattttggtttaacttcacacactcgaagtaagaggaatatattctcaagagcttacactaccaaaacattggggagaaatgcttcctcatcagaatatcttggtatacatgctaaatacaaaggttatggaatataatcttcatcacataatctaaaaattgttaatagacatggtaaggtactggtatttgcttttcataatagatgtgttctttagaattggggtataaatcgtttttatttttttttaatttttggaaatgtttctgagtcataaaatctttttcaaaatgaatctctaaagtccactaag

SEQ ID NO: 138742 - DNA, 1039 bp, Homo sapiens
ccccctctagttcaaccatatcactccttattgccatacaccagtcacttaacacgtttatgtaattttggtggtctccctgtatagatggattaattgatactttccttacgatgtcttagcctcctcgggaagatgaacaaaattagtatacattatgtacaacaatggtgaggcttaaattttcagttattttaaagcctagccttctaaatattcagagggtaagctgtagtctcaagactgcataatactaattctgggattttaaattcccttaacatttgttttagagcttagaaattacattgaaggttatactaaacaggttctgattagtgtgactaaaagtgtgaagtttttaccctctttttaatgtgtaccttgaataagatttgggttgtcttaatttatattcaagtagacataaataggttgcttcacttctcaagatattaagtgaactgttttaaaagacttgcgattaacttctttggtagctaggtaatcacttagttgaacttctgggcaagtgtatgcagaaagctcaagtcaaggaacttgtgagccaccaatataggtactcaacttgctttgaactgtgagtgtttgatgtagacctaaaagtactgtttaatatctgaatgccttaattgtatatttcttactgatagttctgatttttgggttttgcctccttcagctgagtctagagatgtgaaactttagaattattatagcaaaaatagttgctcatggttttggagcacttaactttgtggaactatgcatattcctctcatttaaacctcacaacaatgctatatggtgggtactatgattaatctcattttacaaatgaggaacttaaggtttagtcaaggagaacaccttccccaaagtctcacagctagtaagtaccaaagcaaggacttgggcccagacctgtctgactgcagagctcatgctcttagcagtgtgttttactgtttttgcttatggcttccctatgtcttgctttactacctttagataccat

SEQ ID NO: 138743 - DNA, 1014 bp, Homo sapiens
aaaagtgggaatgtgttagagttcaaaactttgagtttccttatgtattatgatctcaagtgtaaacacatttggatcaatgttgcaatctgactaaattatgggtaagagacactgctctaaaactgggcagatgtaatagcacatggagatcccagctacttcaaaaccatcactaaatatggtatctaaaggtagtaaagcaagacatagggaagccataagcaaaaacagtaaaacacactgctaagagcatgagctctgcagtcagacaggtctgggcccaagtccttgctttggtacttactagctgtgagactttggggaaggtgttctccttgactaaaccttaagttcctcatttgtaaaatgagattaatcatagtacccaccatatagcattgttgtgaggtttaaatgagaggaatatgcatagttccacaaagttaagtgctccaaaaccatgagcaactatttttgctataataattctaaagtttcacatctctagactcagctgaaggaggcaaaacccaaaaatcagaactatcagtaagaaatatacaattaaggcattcagatattaaacagtacttttaggtctacatcaaacactcacagttcaaagcaagttgagtacctatattggtggctcacaagttccttgacttgagctttctgcatacacttgcccagaagttcaactaagtgattacctagctaccaaagaagttaatcgcaagtcttttaaaacagttcacttaatatcttgagaagtgaagcaacctatttatgtctacttgaatataaattaagacaacccaaatcttattcaaggtacacattaaaaagagggtaaaaacttcacacttttagtcacactaatcagaacctgtttagtataaccttcaatgtaatttctaagctctaaaacaaatgttaagggaatttaaaatcccagaattagtattatgcagtcttgagactacagcttaccctctgaatatttagaag

SEQ ID NO: 138744 - DNA, 1062 bp, Homo sapiens
ttcaatagtagcataaacattagaaaaataaatttgctggaaacatgaatgcaatctaaaccaaatgtgattttaaaattatttctgccattaattccctccatatgtgtgaataattgagttgattttatagtgaagtaccttatgagccatacttaagggtttctgagagggactatgaagtttttcctggcttaaattcaattaagttttcattatagggtcactatgacatgaaaaggaaccagtatgaacacttttatacttattcccttctattttaaaaataacttgattatggatttgtattctggcattggtttttgaaccattgtgctttcattctttctagtctgtctaaaaatcactggagcgtttaagatggcagctgactaacataggcctttgaggtcttttggtcttctaaaggaagaaggccaaattttgggcccagtttcttaaggatgttttcaaaatgtacagtggctaaaatcttgtaagcagtaattttgtgtttatgatggctgtctccaagtttgggggaaaataatggcaaaacaaaaaatcacatttgagtagttcttagagcaattcctagagatgtatttcttacctggcctttcctctctaccctgtatctttgcattatttaatacttggaaaaacccacatagcattaaaaacaaagtactactgaacaaagtgataaatacattttcttaaatctttcttttctaaccacaggaacatttaaacttacaatagaattcactgaagaatatccaaataaaccacctacagttagatttgtctctaagatgttccatccaaatggcaagtatcacttttagtacagtgttttaaactactatagtgtttattatggagtattccacatttcctgtgtattttgtggtgcctgagtatttgtttaggcagcttgctgcttcttgaaagctgaacttgttcttggttgtctgtggctgtcttgtcctagaactgaagcagtggaggtattttccctttgcttggagtctgggagcctcctgattttgatgacct

SEQ ID NO: 138745 - DNA, 1034 bp, Homo sapiens
tcagaaccgttggagtccaacctatgatgtgtcttccattctaacatccatacaggtgaatttttccttaatgtgacgaactataacttttaatatgtttatattagcaattgaattgtttttgaaagtcataatgtaatagatctttttatttttggtcaaagcttgtttgttttatagatgaaaagtagaccattaagacccaagtcagctgggtacagtcgctcacacctgtaacctcagcactttggcaggccaaggtgggaggattgcttgagttcaggagtttgagaccagcctgggcaacatagtgagactcttctcccttaaaaaaaaaaaaagccgcatatattttcctagctactagcagattcacataactctgggtttgtatgctaaagacaagaaatgtagctgtacttaggacaattcaattgagtgtcactaccttataaaatagttgttttgcattaaggaactgacattttaaaaattgtctctttagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctgggttacttgcaaaaattactaatgcttcagtttttctgttgtatttcatttccagttttcaggcagttatttttattattgtactttaagcttttaagatgaattgttatacaagaggtgcttatgcttagcttgatgaccaggatgttatttttaacaaaatgattgctgaagtgtttcatcctggctggt

SEQ ID NO: 138746 - DNA, 1282 bp, Homo sapiens
gttattatgcagtccttgaaatttatgtcatggaaccgccctctaaataaaatcttatactgtgatcacttgagcatctaagtcactaaatcctcttggatgggtccaggatggacgagctttctactgagcagtgttacagggaggaagctctagtgtctagtatagcttcatcagagttcttccatagctttaaatttggcatctcacataaatcattagtttccagctgttgtttgttctagaaagaaaatagagcaaacacccttttgtgatgaatgggtcagagctgaggttttgaagttgaaaactttctgaatcttttgataattctttttctttgatttttagtcacaactatgtaaagcaccatcacagagtcactcacctctgatacaaaagagaaaggctttgtaactgcctctgctcattatctgtcttgcattagagccatctgttccattttcaatccttaagtgagcttttcagcatgggtggtatgagattgtactggaacaatcttccagtccacttcaccttccagcacaagtgaagagtatacttcacctgtgctttagctcatttgatgcaaaagcagctaccagtcatgtgtggtggtgacctgtatacttgacttaatggtatattttctatcaagggtcttcccttacatgtggaaagacagggagcatccctccttatgctggaatcttacattgataattgagtctcttcacccaaatggcgtgaagtttttgtgatggaagtatctcgtaccaacaatgcagcttgcaaataatatggttggtactattttcctgcttggttcttttgaaatattcccattttaatgaattgtaaatttcactcattctataggtcaaaatcctcctaaaaagcaagccggttccaaattccatgcgagacctcgttttgagcctgtacattttgtagctagtagttcaaaagatgaaagacaggaagatccttatggccctcaaacaaaagaggtaaatgaacaaacacattttgccagcatgccaagagacatctaccaagattatactcaagactctttcagtatacaagatgggaattctcagtattgtgattcatcaggattcattctcacaaaagaccagcctgtaacagccaacatgtattttgacagtgggaaccctgccccaagcaccacatcacagcaggcaaactctcagtcaactcctgagccttcaccatcacagacatttcccgagtctgtggtagccgagaagcagtattt

SEQ ID NO: 138747 - DNA, 1067 bp, Homo sapiens
ctctatgttggtcaggctggtctcgaattcccgacctcaggtgatctgcctgccttggcctcccaaagtgttgggattacaggcgtgagccacacgcgcccggcttttgtttttatctcatactttggaaatatgtactcccaaatttgaatggaagtgatatgtagaatgtattgtgtttattttattttattttattattatttttgagacagagtctcgctcttgtcgtccaggctggagtgcagtggtgcaatctcagctcactgcaacctccgcctcccgggttcaagcaattctcctgcctcagcctcctgagtagctgggattacaggcgcctgctaccacacccagctaatttttgtatttttagtagagacggggttttaccatgttgggtaagctggtcttgaactcctgacctcaggtgatctgcccacctcagcctcccaaaatgttgggattacaggtgtgagccaccccgcccagccatattgtgttttagactgtgctttctgatgttcagataagagtcaatgaaaataaaattactcttggtatttaaatactcgtgctagctttagcagcaacagttgtcagtgggaagtacaggttacaacagagctagcttccagcagtctgtcggggaggccaccgtgccttgacttctgctttgcgtggaatgatacgtgatgggtgtgcaacctgttctactgaaaatggaaaatgttaccctccttctggttcagaactgattcatgtaaaggtatgatagttactcattttcagaacttcttcccaaatgctaccaggaatctcttttttggtcctaggctggggaaggctctgaaggtaggaagggagagcaggtaaccgtcataaccaacacttcacttgagctcctgtttctgtttctctgtagtaaaatgttattctatcaagcagccaatcttcataaggagccttttttttttttttttttaagagaccgtctcagccgggtgcagttgctcacacctgtaatcctagcactttgggaggctgaggcaggtggattacctgaggtc

SEQ ID NO: 138748 - DNA, 1096 bp, Homo sapiens
ttaatcattttctccctaattgtccaggcaaccagaaagctcaaatggctaaaattgtttcacttcattttttcatttgtctgtttcgtccaagtaaacaacttaaccaagaatttttttctgcaggcaatttctgagatatgtcttgtggctagtgaaaaattagttcagttttctgaccaactacatctacagcacttaaataattgtacatatgaatgcctagagaactgtgtgatttttacttaaaattgtagatagtgtctttatatttaataaagcagtttgattaactggggcatttagttttccagtcattgttgatcaataagattagaaggagaattctggcctactatttacctttgatgagacattaattaatagataaaatataccttaaaatgaaaccagctttgctcccttatttgtcttttcctggttgatacaagactggtgtttggaaggtagatagatgttggctgggctcatgttgcaaaactgtgcacatagtagggagagtgcataaatcactagctaatgaaatgggtgtgagagcttttgaaagattatcaataatctgggtgtatgttattaacttatatcaggagtcttatcaattgttgttgttgttgttttaatagagatggggtttccctctgtggctcaggctgatcttgaactcctgagctcaagtgatccactcgccttggcctcccaaagtgctgggattacaagggtgagccaccgcgcctggcccgagtccttttttctttttcttttttctttttttttttttgtgtgacaatgtttcgctcttgtttcccaggctggagtgcaatggcgcgatcttggctcaccgcaacctccgcctcccgggttcaagcgattctcctgcctcaacctccctagtagctgggattacaggtgtgcaaccaccatgcccgactaattttgtatttttagtggaggcagggtttctccatgttggtcaggctggtctcgaactcctgacctcagatgatccgcccgcctcggcctcccaaagtgctgagattacaggcatgagccactgctcccagctttttcttcttct

SEQ ID NO: 138749 - DNA, 1048 bp, Homo sapiens
tggatcatgagtgaaagcaagtaactgaacataagccacatcattatatctcaggatttaattccaagaacaacacccttgtacataaccagggcattaaaaacacaaagtaggccaatggtagttggtgttaaaggctcaagaattgcaggctgttgtgtgtgcacacaggtgcatctgtggatactatgtatgctacattgtacatactatgtatgtacaccatgttacattgtagctaagtcagtttagttaatacaagaattgccattacattatcaaatagcttaactgaaaagtaatgtttgcattatatctgatagcttccatatagaagaaagggaagggccaatgaagactcttggaagctagggaccaagtgcagtctttagatgggctttatgttacctctcatcttcaggtgggtaaaacttgtgttccaatacttgttgatgttaatgtagattttggcagagttcttgttttctgtggcagaatactcttctctcaagtgaattgtagaatacatggtgaaatagctctttctaaacttaaattgttaatttttttttttttttttttgagacagagtctgctctgtcacccaggcaggagtgcggtggcacgattttggctcactgcaacctccacctcctgggttcaagcaattctcatgtctcagcctcccgagtagctgggattgcaggcatgcaccaccacacccggctcatttttgtatttttggtagagacggggtttcgccattttggccaggctggtctcgtaccccggggctcaagtgatccgccagcctcagcttcccaaagtgctaggattacaggagtgagtcactgcacctggccttaaattgttgatttgttgctcgaggtttatcacttgacttttggaacaggctgtgaagaatagcacaaaggaatttccttgctcttttttccctctggcaaaatgttttgtattccattttacttggagctgaaataaacttctaggtcaaagaaatctttgaaaattccttcatcataagacc

SEQ ID NO: 138750 - DNA, 1083 bp, Homo sapiens
tgcgcataatgtgtctggactcaaacaaagaaatggatatatctactgtaaaaatggattgccctctttttaccctaaatgggatcagaaggattaacatttggctctgagtgaggttttaggtgtgtgtgtctgtggtgggggtgggggtgtgtgtgtgtttgtttttcccccctttcctagaacctggtgacgttttgaacaggcctctttgaaagctctttgcattcaatggagactgcagtatggttccaacgcagcgtgttttgtttgttttttttttttgaagaggctacttggacctctgtccttcagaacccctaaatcggccctatactagactattcattctttgatagattgggagacgacttcttttgacattcctgcaatcatagttttttgtttttgtttttgtttttgtttttttttaaatcaggaagggtgagagattctggaatatgatcatgtcaattttggccagttcagttccaggagtgactgtaacagatgcagaaaaataggattgtctcctcctgcccttaattattgaacatggcattcagtgtgatatactttgctctcatcacagacattacttttctgtcttctcaaggttagcataatttctacctccagagataatgattaggaggaactggttacaactgaagaagccttagttattgaacaagtcagataaatctacttgacctttgcctaacagtgttgttcttgagttcaaaagttacctttatcctataatcgtaagtctccataatatcacagaaggctgtcggaaatctgaatccttaaaataaaaacaaaaacttaaatgaggataactatcctttgtgttaataataaatcttaccttcccactagaatggaagctcccttaaggatagggattttgctttcttgtttacacctttatcctcagtgcctagaagattgcctgctaaataatagctgctcaataaatgtgtgtggagtgagtggatgtatacagctttatgatgtacaacacattttaaatatttattatttcatttcctacaacaactttggggattaggtggc

SEQ ID NO: 138751 - DNA, 1055 bp, Homo sapiens
ttgcactccagcctgggtgacagagcaagactccatctcaaaagaaataaaaatacacacacacacacacacacacacacacacacacacacacacacacaccagctctgggcccagctgtgactctttgcagccacaggcaagtctgttgacttctctgtgtttcttggtctactcatatgaaatggggatcagttctacttgctgtatttatgtcacaggaatgaaatttacatggaagagaggtcaaagtattatttaagcacaaaccaatgatgggtttccatagttcacattttcaggtaactgtggtctggaccctagaacagagttctgcaatcatccccatatgctctgcaaacaggtcttgccccagagtaccagttagctgactaggacagctctaaggatctcctggggtgaaacctcagcctcctctactttcccaatgggacaggaaatgcagtggctagagcctggggctctatccagtggcctgaggccacttagagatttgtggaaggtattcctgtacaaggtattgggtggtggtgctgggggtgggtggtggtgctgggggtgggtggtgggggacactagtcaggacctagtcattaagaagagataggccgggctcagtgcctcacgccagtaatcccagcactttgggaggctgaggcgggtggatcacttgaggtcaggagttcgagaccagcctggccaacatgatgaaacccccgtcgctactaaaaatacaaaaattagccgagcgtggtggcaggcgcctgtaatcccagatactcaggaggctgaggcaggagaatcgcttgaaattggaagatggaggttgcagtgagccaagatcacggccactgcactccagcctgggcaaaagaccaaaactccatctcaacaacaacaacaaaaaagagccgggtgcagtggctcacgcctgtaatcccagcactttgggaggccaaggcgggcagatcatgaggtcaggagatcgagaccatcctggctaacacggtgaaaccccgtctctactaaaaata

SEQ ID NO: 138752 - DNA, 1057 bp, Homo sapiens
aggcctgagcccggccagcactcagtaaatgttatattattataattgatgttattattgaccatgtgtggtaactatggggactctttttaacaaaatgtctgactaaacacaatgcagtattcctttaccatattcaggagcagagacttggagataaaatggcaggaagagagaacgatccagagcatggtgcctttggtgccatcatagcaatccctgacagaaatgccccctgaggttccagggtcctgcagggtcacagccctactggtccccacccacctgggcttggccaggctggggactgctcacaggggattctctccaatctccctgtgcttccctgccagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaagtaagtagcaggctgctctggggtggtgccttctctttcctcctgctcatcctcccagggcaggacgtggcacctgaaggggctgaggactggtgaccagaggtgagctgtgggctgtcagactggttgaggtacctataactggtcccagcatccctgtggcacctttggattccctgagcttggggagttgagagtagcagaggggtgtggtcccagaggcccagcccatctgtccagcttgctcaggaaagccctgcaaactcaaggtccataggaaaggaagggaaaagaggaaaagcaaaggagagtgagagagcagaagggaagaaaaaaattagaggtgcagcaatataagagaggaacaaggccgggcacggtggctcacacctataatcccagcactttgggaagccaaggcaggaggaacacttgaggtcaggagtccaagaccagcctggcctatatggcgaaaccccgtctctgcttaaaaaaaaaagaaaaaaaaaatag

SEQ ID NO: 138753 - DNA, 1050 bp, Homo sapiens
gtggatggtggtatcatgaatggcaacagggaatgttggagacacatgcttaagagggcagaagatgaatttgtacagagcttgattttcggggaggtcctctatgggatgtctgagtggacatccaggatgcagttggattaatgggtttagacctcagaagtaagactagcttgggaaccatctacttctaggtggtaattagggctgtgagagtagaaagaaccagctgcaaagagaacagaaagtgaaaggagcagaggctctaggaaagaatcccggggggtatatcaacatttaaaggagtaaggtgaagaaaacgagcctgcaaaggaggctgagaagaaatagtaggagagataggaatagaatcagccaggccagtgctagaaaagccaaaggcagagagcatttcaaggaggcagtggggaatggcataaagtgctgcgttgatatcaaataagatggaaaccaaaggccacattgaacttggccacaagtctgcgattcctggccttggagagaggcatttgagtggttatgctggggacagaagccagactgcagtggattgaggaatgaatgagagatggggaagaggaaccagtaaacatagaacaactctttctcctcatcctgtcaaggacttcttgacaggacagaggctggtaagaaagagcagggttaagggagagtttcttcagcacaagaatgcttacatgcagcatgggaaggagctggcagagaaggagtgaagaaggcgaagacacaggaaacagaggtattcaggatggagtgaaggaggagggaaggagacaaaatgaccaggtggaggcacacctactcctctacaaatgcagatgaaagctgcaggtggggaagacagccagggagctcccaccagaaaaagacaagcatggcttcccccagccccacctgtcagtatatagggcatgagcctgtccctcctgaagcaaatatccccaagggactggttaggctctgactccaggccagctttaggctgtgcacaggtagagtaagatctca

SEQ ID NO: 138754 - DNA, 1051 bp, Homo sapiens
caccccacacacccactggcaatagctggattttccataggtaggacaagactggttatcagagctgtgctaagttctggtcttctctgctgttcggagctggggatgctccactaggaacgtttgcaaatggtttctggacccacagtgtcccaccctgggaatggacttgtggtctgagaaacaggaacctgaagtgagacgaggagaagccagtagacatggttccaatgacttatttcatctgatgtggactactctgaacctaaacagaaaagggggttttgaaagtttttcttgtaagtctaagttgactgttccgcttgaatgaggaagaagttgtatattgctcaggcagcctgcagggccctcggaggcactccttctgactcaccattagagatcactgtccagagatggaggaggagatggcatatagcatagtcctgagaagttgtcttactgatgtcatctttaatattagcctgtgttctatgacagcagggggctttattcctaattcagtgggtcttaagcagagggattatgtgagctgattcgggctttggaaagattaatgaccacaaggtagtctgcttcaactatggctgacccacttatcccagacccttctctgccctcactaccctcttccagaccctgcaagacagaatctggggtgattgcctgttcacttcagacaccatttttcctacttgttcagggcaaataccaccatccgacacagtgaagccatacctgtagccaccttgacaaagtgctcctcgtgacctggtccagccagaaatcgattttgctatgacttggtccacatctgtcattcttgaccactgccccaaattgcagacctttgcttgcactcttttgaggaggggacttgttcacacaggccagaaagtggggtccccttgctcctagtcaccactgctactgtcaggccattatctaccttctaaagaaaccacctccttggaagcttctaccatccaggtgggccatgcctgcggtccacacccctccttgtcactgt

SEQ ID NO: 138755 - DNA, 1070 bp, Homo sapiens
caccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacaggtaaagaaggcggtggggtggggtagggtggggaggttggtagagggccgcagagaggagctcaccacagagatcttgaagacagcacagatatcgggcccaagcctgtcctcccagaatggtgtgggcagcagcaggtacctcccaagcataggccctgtctggtgtccctgtctacagcaactgttccactccactcactttgccaaaagaagggtgtctttctagtatacatgggtcaggtctcaattccatgcagcaaacatttattgagctcctaccttgcgccaggtactgtcgagctctgaccatctaaaaaggaatggcttagtctctgcccttgagggactcataggcaaaaccggttttaagcaaataatttccatagagtataagatgttctgtaaaggacagggtacaaagagataaaggacaagttacaatgagaacacaaaggcgagaaccatcaattccacgtagggaggtcagggaagccttcacaaaggatgtgcctcctgagctgactcttgaaggacgaactgttttgccagacagacaagggaatggagagaggggcatctcaggcagaagtaactgcctgtataaaggcaaagtgatgtgtaggattctggtatgttctagggaagtgtagcttgctctctttggctagacagaggcagagtcactgtgaagctaatgaagattgcacaggccccttccaaagctctgtaactaatgttcaatcacaatgtcgtattattttcctcagagagtctttcagattgcataagcctaagggctggaaaaacctggttctgcccctgggctaacacttggagtaagcttggggaaaaaacggtgagatgaggctgaagaggtaagcaggtgccagatca

SEQ ID NO: 138756 - DNA, 1031 bp, Homo sapiens
gctggacatgtggggtttgacagcttgcctgaccagctggtgaataagtccgtcagccagggcttctgcttcaacatcctgtgcgtgggtgagtatttccatagcaggaaattctattacagaatatggatccttaatggctggatacggctttgcaggtaattaggttaaatagtgtgtcattctgatttagttgcgagagtgtctctcccctcttcttttatctctctgcctgttttttgtaaacagctggctgtaattacttttttcccctggccagatcagagtatagggccatatcttggggggaaactgagctatgtgagacccagtggaaattctgtaagggagctggctggctcagtatggctgtagagttcattttgactacagaagacaggatccagggcagaattgggagggaggggatagctgacaaaaaacgcctgcccaccagctgtgggcagtgggttgggtctgtttcctctgtagttttgctgtgcttggtttagtttgagctcgggtgcaggcaccacacagctgtatgcaacattcttttattccctttacctatctctctgcctagacttttttttttttgagatgggggtctcactatgttgcccaggctggtcttgaactcctgagctcaagcaatccacccatcttggcctcccaaagtgctaggattacaggtgtgagccactgtgcccggcctctacctagacatttaatctcaacagtgggagctgcatcttagccccctctatttgctaatcacagcacaagtagagtgcggtaatatctgtgaaatgaatgaatgggtgaatgccacaggaaccattcattatacttttcactttctcacattagctcttttggacattaccaggactctgcgaagtgagcagagcaagtagcatttgtatcctcatgaaacaggtggagacacagagtcttggggaggataagggacttacctgaggcaacacagaagaagtggcaccataatgaggactcaggcctggttg

SEQ ID NO: 138757 - DNA, 1746 bp, Homo sapiens
atcatgtatcactgaaccgatgattcatagtcttggagatttgcacggtctttcagacatcagtgttcagggctgagagtggaaatggagaaaagggaggtgtgagagcttgggcccaccagtaggtgactgaagagagtccggtttcagtgtttcttttctttcctagcatttttgttgttgttgtttgtttgtttgttttgagacagagtctccctctgttgcccagactggagtgcagttgtgcgatctcagctcattgcaacctccgcctcctgcgttcaagcgattctcctgcctcagcctcccaactggctgggactacaggcatgagccaccaagcctggctaatttttgtattttcagtagagacgggttttcccagtgttggccaggctggtttcgaattcctggccccaagtaatctgcccgccttggcctcccaaagtgctgggattacaggcatgagccaccgtacctggccgctttcctagtatttggatgggaatggccagaggagaaagtttagggacagcctagtcatcagcaatgagtttcaaactttttgcttttattctttagaatgacagctactaatttagccaccctggtttgaaacagaggcgggaaattctccattgacacagatgcaccctcagttcccagaggcctcaaatacggcttgcttactatcacagaggttggaagaggggccaaggggagtgggggacagaggtggcctactcgggtgcttaagggactctttattttcagtaacagcaatgagagaaagatgcgcagctggaaccaccataacttgttcttgataatatgaaccttacgaatattcaattaaaaaacgaaattggtgtgtcctcaggagaggaggcagaagagaaagagagcagtgtttctgcctgtgatatgaaatgtggtataacgtatttaaaaaccacaggtgactgcagatgaggagaaaacaggaaatgtaattggggaggggagtggggcgctctcccagttctcaggagcactctttcattttgccttccttttagctcctctcagactctctgcatcctaattacccctgctgcaaagctgagtgagaactcttctttcttatattaaaaatgttttaaaattacatgggtaacatgcgaatacattcgtgctataaaagagtcaaacaatagggaagcataccgactactcccttgactgagcccctatttccatccccctcccctgaggtagctacgattgtgggtttggtggctgtattttcagtcttctttctatgcatccacatacatttacgtgcaaatacacatctacagggcttctggggcatatatgggctcatattgtgcttatagtttacaacttctattttcttttttttttctttcttttttttgagacagggtctcactgttgcccaggctggagtgcagtggcacaatcttggcccactacatcctcgacctaccgggctcaagcaatcctcccacatcagcctcctgggtagctgggactacaggtgtgtgctaacacacttggctaatttttgtattttttgtagagacgggattctgctgtgttgcccaggttggtctcaaactcctgggctcaagcgagccacctgcctcgacctcccaaaatgctgggattacagtcatgtaataacttccattttcttctattttattacagtcgccctataacttctgttttctgttttat

SEQ ID NO: 138758 - DNA, 1035 bp, Homo sapiens
atctaattatctttgtgataagtgctacacaggagagtgactgcctgccatgagatttcattactaagggaacctaactcagcaatgaatggaggcagagggtgacaggaagggcttcctgagggcttcaaataggaaatgggtaggtgtgaaggtgggtgagatctcacatctgctactgggttgggaacatttcatttgccaattcacccacttttattttcattcattccttcagcacatattcactgggcactgatcggccaggccccgtgccaggtgctgaggatatagtggtggccaaggcacgcaggaactctgccctctcacagcttccagatgaaaggcaggaataagccctgtttcctttttacatcctaaatcctggaaatgtgagtgttagcggtgttcttaatacaaaactacattatagcagagtgatttgtctgtatcatctaatgagattttgatctgcagtcatgtgcatagcatttactttgtggagtctctgctgtaaattttctattaattgctggctttgttaccaagcatggccactgcctttgtgtgctataagggagcaaacctattgcattagcctgagcaaagccaattaggaagataagtcctctggaaaaaggtattcccaaactaagtagggctgatttctggacttgcctgggtttttggatgatcagagccatggtttaatattagcatgaacaattgagaagggcttttagttgcatgtacattaaaactacattcaagacagatgaggccaggtgcggtggctcacgtctgtaatcccagcactttgggaggccgaggcgggcagatcatgaggttaggagatccagaccattctggctaacacggtgaaaccccatctctactaaaaattaaaaaattagccgggcgtggtggcgggtgcctgtagtcccagctactctggaggctgaaacaggagaatggcgtgaacccgggaggcggagcttgcagtgagccgagattgtgccactgcactccatcctg

SEQ ID NO: 138759 - DNA, 1719 bp, Homo sapiens
ggaggattgcttgaggccaggaatttgagaccagcctgggcaacatagggagaccacccccgtccatctctaccaaaaatataaattagctggacttggtggcacgtgcttgtagtcctaactatttagcaggctgaagtgggaggatcacttgagcccaggaattcacaggctgcagtgagctgtgatccggccgctgcattgtagcctgggcaacagtgtgaccctgtctcaaaaaaagaaaaatgtatgtaaaactcaacgcctagttcaataaataacctgctattaaactctgtggtctcctagaattgggaaggtattttgtacgtaagattatatacccttgacccagataattgacccaatggaatgattttcattgttttagctatcttccagcgttaaaaatgtttttgaaagcaggttgcaattacagtgcttcattttgtggaagtactgccattatcctgctgaaagaaaagccgtgttaatcatttttgattttgcctttatgagggtaaaatcatgacagattgacatggacaattctgggattgctgtttccctgcactagacgtgaatggaggagttgatcgattgtaaagatcatgcgaggccaggtgcagtggctcatgcctgtaatctcaactctttgggaggacgaggcgggtggatctcgaagtccagccagttcgagaccagcctggccaacatggtgaaaccctgcctctactaaaaatacaaaaatacaaaaattagctgggtggtgttgggggggcgggcgactctgtctcaaaaaaaatatcatgcgggagcttttatatgtttgtgacccattatgagggggttcagagtatgtctgtgtacctccaggtccattgaatcaaaagtgggtacaagtacacttggagagagtgggcttcgccactactctgatcctagttaagagcctagccttcaaattattttgagaggataaaacttgacttggctagtttttaaacacatagggaattattttttttactctccagaaagaactccaaacttgttagaggagagaaaagcagtaccctttgtattttgtggtacctaaaaggttatgtgaatgggaacagctacattgctgtcagactgcctttgtaacttgacatttttttctgtgtaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaattgctgttgtattgtggtttgtcaattactgaattctcccttccctgccaaacctaataacaacactatccagtagaactttctgcaatgatagaaatgttctctggctaccatgtgcttgaagtgtgtttagtgtaaaggactgattctgtaaattttattttatttttttttaatgtatttatttattttgagacagagtctggctctgttgcccaggctggagtgcagtggtgcgatcttagctcactgcaacctccacctcccgggttcaagcaattctcttgcctcagcctcctgagtagctgggattacaggc

SEQ ID NO: 138760 - DNA, 2394 bp, Homo sapiens
ttcttccgccagcttccctcctcttcctttctccgccatcgtggtgtgttcttgactccgctgctcgccatggtaagtccatcggcccccatcggccccggggtggcttcccaaaacccgaggccgctgccaggaaatgcctgggccgcgcggagcgttgaggggcgggagccttttaaaggctttttcaagaaaatatccagttcggccactgttgtctttcgtggcctggagggaagctagtgagccagcgagcaacctggagagggacgggctgcgctgcggccgcggattcaagggggctctttctttgcccggccgctgccgagtcgggcagggattccggtttcccttcgcttgtagcgaactcgttctggaggcggggggtgggaggtggcagccacccccgaaatcgtggcctgactgtgggctgcccgtggcatgcgcaacgtggagggtaatcaggagggtattgtgggctactggttttcgaaaagggtttagcttggcgtggagaagcgaaccgcatttttagatcccaggacttttgtttagaggacgtttattcagagacttgagcgtcaccccgtggaagcgcctagaacaaggggtgttttgcgaacctgtgtgtcattctggccttcttagtaaatggcagcagcgaaccagtcactctttactgggaaatgtaaaatgttgatttctagatatggaggcgataagtactggtattttattacttgtcaagtaatttattacttgacaaaatttacaactgctactgtggatgggggacggggtgtaatctttgccttctttgtattggctcccattattatgcaagggtatgttcgtccaggttggccaggcattaaacctgcatccgtgccaattttgcaagattattctgtagatttgggggagtattggggttggccttagatgaaagccaaaagatgcaactagaaattgagacagtcatccttggaaaagtgacatttcatttatttttaaatttaaaagtttatttttttagccagtgaaatttagcagtagagatagagttaggattaataccgaaatggtgagtaggttagatcttctgaatgtcagggactttccctaagtcttaattaccctcccaataacacttgaaaagtacgtacccctgttttacaaagtagagcactgagattcgttgacttgcaaatggtaggtaggtggttctgtttgactcaaagctgtgttcttcccaggaagccagattccctagccattcccagtgtggtcgtctgagtccttgggggaccacagggtaaattgaaaggtagcctctggctgtggagcagaaaggacctgggtttgaatcctggttctgcacattgatgctctgattttgtgcatgtttcttaaccggattccacttattttatctgaacgatggaaactgtggtatctgcccccagagaagttgtgagggtcagagacttgcttggcttgatggcttagcattgagaagattttggggctggggtatgtgttaagcactcaaatgttggtttgaaggagttcttgactttgaatcattcgggcaggctctaatattgtctaaattgattgcattttcttcccagtcttctcacaagactttcaggattaagcgattcctggccaagaaacaaaagcaaaatcgtcccattccccagtggattcggatgaaaactggaaataaaatcaggtaagacctccatcatactgcttgtattttgctaaatgtaagagccactgtgtctggccagggttactttttgagtataaatacatgattaaaattgcatgcaatccaatccaccctttgacagcattctcaaattcgtttttaaaaacgtacttcctttgtttctgcactgcatccagcccacatctgggcttatgggcagataattctccaatacttattaatttcctggtcatcttcagtctgagctaggtcataaggtggaaggctgtcttatacacatcctggtggggaagacccagtcagtatttttaggctttttgtttttgtttttgtttttgtttttgttttgagacggagtctcgctctgttacccgggctggagtgcagtggcacaatctcggctcactgcaacctctgcctcccaggttcaagtgattcttttgcctccgccttcagagtagctgggactacaggcgtgcgtcaccacgcccagctaagttttatatttttagtagagatggtatttcactatattggccaggctggtctcaaactcctgagctcaagtgatctgcccctctcggcttcccaaagtgctgggattacaggcataagccattgtgcccggcctttgtttttgttttttgagacag

SEQ ID NO: 138761 - DNA, 2560 bp, Homo sapiens
ccatgttggccaggctggtctcgaactcctgacctcaggtgatcctcccgcctcagcctcccaaagtgctgggattacaggcatgagccaccgtgcccagcctaatgtcttttttttaataggacctaaacaaattccacaaattatgcttccttgaaatgtcttcttcagttctcttttgtttttagtttattttttgagacagagtcttgctatgtcacccaggctggagtgccgtggtacaatctcagctcactgtagcctcgacctcctgggcttaagccatccccctacctcagcctccagagtagctgggactacaggcatgcatcaccatgcccagctaatttttaagtttttttgtagagatgaggtctccctatgttgctcaggctggtctcaaacttttgagctcagccgatcccctcaaagtattgggaataaaggtatgagccactgcacccagccaagttttcttttaatctaaacaatttccccttctcttgttttcctaccatttgttgcagaaaccaatttgtcttgtagggcttttcctgttctgaattggcagattacatccccatgctgttatttaacgtgttcctctgtcttctgtgcttcctttaaaactggcacttagggcctggcatgatggctcatgcctgtaatcccaacaatttgggaggccaagtcaggaggatcacttaagcccaagagttggaaagcagcctgggcaacatagggagagcttgtttgtactaacaatgtaaaaacagcccagtgtggtagtgcgtgcctataatcccagttactaggtacctgaggtgggaggatcgtttgagtctggaatgtcgaggctgcaataagccttgatcatcccacttgctcttcagcctgggtgacagggtgaggccctatctccaaaaaaaaatttacccaagcatataaaatagtaattaccaaatggttgcttttctttggagatggagagaggaagtaggcaagttgtcatttaccgtgccctcacatttttggtcttaaatgacttcacttgagcatatattcatacataactatgactcttaaaaatcccatataaaagcttagtagcattgttgtaatggtaacatattttattgtacttcaggatcgtccagcgatgcagctttaccaaccaggagctcgaagccgaaatcgactctgtccccctgatgacagcaccaagtctggagattcagcagcagaaaggaagcaggaaagtggtattagccatagaaaagaaggaggagaggagtgataagtccagatggccttaggtgtcctgactgtctaggcagccaaagagcacacgttaagcaatccagaggtgccttcagggcaaagaatagagagaaagggagccgctgtgctggtggggtacactgcagaggagtaagtcttgtgtcaaagcaggaatctgatcagaggttcagaattggaagtacaatttcattgcttttgcaatttctacaaattaattttaaagtgtcagaaaaaggtgacggcaaggacatgcattgcaatttgcagggggaattgtcaagtgaggacttcatcacatatgacacgagagaaaagtaagagctggttctaaaatcaaaagctgttgttcatcctgaattgaattttctgaatttgggtggagcagagtcgctttgaagccttgttccgatctaattctattgtattgttgatgataagtgttgacattgggtagtgtagaagcaacaagcatgtccttgtagtacaggtacagtgaaggatagaacacactttcgttgatacaaaaatttaaatagttatgttacttctgtatccagtgtcctaaagttttaggattagttttagttttttgtttgcttatatgagcttagcgtaaagaatatttttaaacttcgtgttttgtcatcagcatcttttctattaagaggtaaaatgtagtccttgtttgactcttgacaatccagtgtgtttgatcttaggtctcatgatctgagtgcataccctctccaggaaggaaactgcaccagtgtctattcctgttaaatagcaacttttagtctcagcttgtttcgttttgatgtcaataaatagtaacagcattcaagtgtgaagctaagtgtgtttattaactttactaaatagctatgagttttgagaaattaaatttttgacatctgacatcactcaccttctagtgaagcctaagggagctttaactcatggcagaaggtgaagtagaagcaggcatctcacccaaaactgtaaacaaaagtaagagctggttctaaataaaacaaataaaagtctattaatttaaacataaaataggctggatgcagtggctcacgcctgtaatcacagcattttgggaggccaaggtgggcggatcacttgaggtcaggagttcaagaccaccctggccaacatggtgaaaccccatctctactaaaaatacaaaattatctgggcgtggtggtgggcatctgtaatcccagctactcgggaggctgaggcacga

SEQ ID NO: 138762 - DNA, 1683 bp, Homo sapiens
cagcactgtgggaggccgaggcagaaggatggtgtgagcccagaagtttgagaacagcctgggtgacatgatgagaccttgtctctacaaaaaaattaaaaaattagccatatgtggtggtgtgcatctgttgtcctagctactcaagaggctgaggcaggaggaccacttaagcccaggaggtcaaggttgcggtgagccatgttcatgccactgcactccagcatgggcaacagagtagtgagaccctgcctcagaataaaagccaaaggagtcttgatcctattgccacaaagtgattaaaccacttcgttcaagtggataacactttaacattaatagcatccttttagtaaattactactcttatgcactagttgttcacctgaaagattaagtgtacctgcagagatagggggctttgtctagtctaaattttaaatatttggtatactgggtttttaatagaagatagtgtcccagccttcaaaataaaaataaacattttatctttaaagctgctcaagaagccagaaaaaggagatgaaaaagaattggacaaaagagaaaaagccaagaaattggacaaagagaatctcagtgatgaaagagccagtgggcaaagttgtacattgcccaagcgttctgatagcgaacttaaagatgaaaaaccaaagaggtcagtagtcaaggactctttgttatgtttgatttatacatgctagttttgctgctatgtcctggacatgtacctgaattaagataagctgttttatgcagggcagggggatgaggaggaacagtttcagaatattcttgtatcttaatctgggtgaatggttttggggttttgttccttcttaaaacactagtatttttcactctgctctaaaagtgcaacctcattgcaggggccaaatcagaatcacagtgttcctgcatttgtgattacaagatctttcagggttctgtctcagatttgtttttcatgcagacctgaagatgagagcggcagagactatagggagagggaacgggaatatgaacgagatcaggagcgcatacttcgagaaagagagaggctgaagcggcaagaagaagagcgccgtaggcagaaggagcgctatgagaaagagaagacttttaagagaaaagaagaagaaatgaaaaaagagaaagacacacttcgggataaaggaaagaaggctgaaagtacagaatcaataggcagctcagaaaaaactgaaaagaaagaagaagtggtcaagagagatcgaataagaaacaaggtgctgcttgtcattaaacttgtttatgagggtttttttcccttttcctgcaagtgtaaagaaagtgtaaagggcactgttattatagaatttttaaaggggaactttaatcatctgcaacttttttttttttttttttttgagacagagtctgactatgttgcccaggctggagtgcagtggcacaatctcggctcactgcaagctccgcctcctgggttcacgccattcttctgcttcagcctcccaagtagctgggactacaggcgcccaccaccacgcctgacttatttttttgtatttttagtagagacagggtttcaccgtgttagccaggatggtcttgatctcctgacctcgtgatccacctgcctcagcctcccaaagtgctggg

SEQ ID NO: 138763 - DNA, 2515 bp, Homo sapiens
tataaacattttaagagcattgggtttctagaggagaaatagctgctttttccaccattactctttaaggatttgccttcttggtctcactctctagcctgctccttcactctggttgttggaccaggagttcactctacaaacgtggaatgttcttaggttgtcccagagacactcatttgatattctgaaagcctctggagagatagtaaggcagcagtggaagaataatattagcaggttctggtcttcattgtctttcgttttctgggtggagtggggataacggtggtagaatgccactttgtagaaagtaggaaggaaagattattcagttggggcctaccatgacttcaggatttattagggttttggtgatgattattttatttgaaggcttgtgttgatgtttctttctagagaatgagagaagaaaagagagaagaaaggaggaggagagaaatagaaagaaaaagacaaagagaagaagagaggaggaaatggaaagaagaagagaaacgaaaaaggaaagatatagaaaagctaaagaagatagacagaattccagaaagggacaaattaaaggatgaaccaaagattaaggtataagaatgttgaaactgactgcatgttgctaaaaattgcacgtatctacttctttaaatatgcatgcgtcttgtgttggtgtaaatgaattttttgttttgtttttgttctcttttggggggaagtgatccaataaaaatctttcctgtaatagtattagtttttaaatttaagatcatttaaaaggataaagtagtatgttatttcttcagtgcagatctgtgctgtttttgtcattgaaaatgttggatttttagactattgtcctctaaattcatagtaaatgagggcttagggctggctggcatgatttatggttttttttcagctttttcttcataattgatacatgaagttacctcatctgtttgttttccactgtcttcaggtacacaggtttctgttacaagctgtgaatcagaaaaatgtaaggaccaagtacatgatacagagcatctagtatcatgtcacacacacaggtcttagctaataagtccttttggtggtggtggtggtagtgttacttgttgaaaaccccttcaggttgacttgagtcttcttaaaagctgagctattttattataaatttctactttaaaaggaagcccaggtgacttcctgatgctctgctgtgtgcccagaagcttcattgacctacagccagaggacaaccatgcctatatagttctttctcatcttcttatatgcttctcataactggctgccttgtgggaggactagggataaataccctgcaatatgtgcctttccctctcacatgactcccgtagtatcttcctgcatatatctgggaatctgtgagcagcagattcggattcatgcattgcatttgggaagaagaaaacctgcagaaagatcccaaccttgccacttcccttctaagggcatggcttgggcagcccttgtttcaacatatttcctggggaagtactagtacctagcacttcagataaagtcaaagaaaatctcacagagagggtggcagggtctccttattttatttcctgaaaactcagcagtttatgtagcaagggttccctaagtctctacggggctcattactgatgatgaggggcttgggggaggatggagtttctcatcttaattctttccagcaatctctctgtctgctatgccacaagtgacttgacttgctattcctaacaatcagcaaggcagaaggtagagccagccatgctagagacattcattaatgttcttattagagtaatgaacaccttggtttctaataaggatgttcattggagaaataagagcacttccaatgaaacctgcacatggtatcctcattttacactggtgccttctcagtgtccattttggactcaccatttgcagtggctgtctgtgtgccaaaatgctttgtgcttatgtcttgtggtgctttgccttttgcttagtaatttacatgatgccttcaccctgagatgaaccttgtgtgataccttcactctgagacttgaaattcttctattttgcctaagaatctctctgattatccgacacttggaggtattctcgagagattcatagcagcaatgtaaaaaacaatggcatttttgaacatgcgtaaatatggcattaaatacagagttcctactcagtagagatggaacttcactatttggttgtataaggcctttagatttttaaatcaaatgccaaataattcttgttattaatctctaatggcaagataattgtaccatcataagtatgttattctcaggctcaaggcaaaattattcctgcaatggatctctcctttggtgaccaaggtatttgtcattccaagtactacataaaaacagtcccaacagaaacgatctgcctatcacttaaaatttgtgggctgtttcccattaag

SEQ ID NO: 138764 - DNA, 1852 bp, Homo sapiens
taacaaatcaccataggtttattgattagaagatagtggaaaggccaggcgtggtggctcacgcctataatcccagtactttgggaggccaaggcgggcggatcatctgaggtcaggagtttgataccagcctgaccaacatggagaaaccctgtctctactaaaaatataaaattagccgggtatggtggtgcatgcctgtaatcccagctattcgggaggctgaggcaggagaatctcttgaacccaggaggcggaggttgcagtgagctgagatcacaccattgcactccagcctgggcaacaagagcgaaactccatctcaaaaaaaaaagaaaaagaaaatagtggaaaaaaatcaggtttcaaagtttaacaggtgcttcttgaggcctcaccatttttatgattatttatttgacttttggtttccattatatttataaagaagaaggtttgaactgtcatgggaaaatttccatacccaggtaactttgtataaagtagctgaagttgtcactcctattttctggtctttggatatacaattagctacacacatagtattaggttgaacaggaatagaagaactgaggccaggcgcggtggctcactcctataatcccagcactttgggaggccaaggcgggcagagttgctgaggtcaggagttcgagaccagcctggccaacatggtgacaccccatctctactaaaaacacaaaaattagctaggcatggtggcgggcacctgtaatcccagctgcttgggaagctgaggcagaagaatcacttgaacccgggaggcggaggttgcagtgagctgagaccgcaccattgcactccagcctggacaacaaaagcaaaactccgtctcaaaaaaaaagaaagaaagaaagaaatacaagaactgaaaaaccaaaataattgccatttaaggtacactggctccagattttgagacctctgtaatgttatgttagatagctgttacacaactctttatgttggataaggactaggaccatattttatatcagattgttactttagaatcatctagtttaatttccatcatttgttactattacaggtattttataaagaaaacacggtaaggactcaataacacatagctgtgatactggttttattacagatttagatctggaagacttgatcaagtgacacatagaaacaagcaatataatggcttagatgtgtcaccctttctgatgttagaggtctaggagagaactccaggaattcccatcacctcaagtgccacatctaggacttctctctaatttatctttttggaacacctaacttagtttagtaggacagtgacttttaaaagcaaactatgtaatacccctagtggttctgttataatgcatggcgtctcatttttcctgaccccatgttataccagattcctatagtgagtatcagtgataggagtcctgagagcaagtgaccaattaagctctaaatagtctaccttgtgggtatggtttggttttttttaatcttccacgaagtaaaaaattatcttctttgataaatcagtattgtagataatgtcttctttttttgtttaaagtctattatattttctgtttcctcaaatgattatttagatccagaatatagaaagtttttggaaagttatgccacagataatgagaaaatgacatctactccagagacactgctagaggaaatagaagcaaaaaatagagaattaataggtaagtgggcaaaaagaatcagggcaacagtcttttcatcacagtacctaagtctcctacctccatcagttgctagctgtgtgacttcagggaagtta

SEQ ID NO: 138765 - DNA, 1004 bp, Homo sapiens
accaaggagcagcttcaggaacatcttcaacctatgcctgagcatgattattttgagtttttttctaatgatacgaggtaaaaaaaaaaaaaaaaggaaaggggtaaatgaaaaaggtttctttcattctttttatcctactgtttttcatttgatttttgagcttgtctttaatatatgcatacttgtaattgggccagacacctgcgagtacatttacataattgctttcctctctgcagtttgtatcctcatatgtatgccagagcatacatcaactttaaaaaccaagaggacattattttgttcagggatcgctttgatggttatgtattccttgacaataaaggtgagtcctggtaactgaagtaaaaagggaatttctttgtcatttgtatgtttaagacaactcgtgcattgcgttgcttcctagagttttacacatttaataagcttattgcagtcttataaatagacgtgacttttcacagtccttggttatttttattaacctactatttttttagtttgatcaactgagtgaaattgcaactgttttctcctcgtgtgacacattttttgccctggcttaaacctgctgttttgactgtagaatttcagccgcagtactgataagtgactcttaaacttgtttgataagttttaaatatttacttcttattttgcttcgaggacaaacatttatttaattcaaatccattaagccaacagttcccaattgggatactgtttaacattctcacaaagttgtatataattaaaacatgaaacttgatacatctcggcctggtgtggtggctcacgcctgttatcccagcactttgggatgccgaggcaggtggatcacgaggtcaggagatcgagaccagcctggccaacgtggtgaaaccccatctctactaaaaatgctaaaaaaattagccaggcgtggcggtccacgcctgtaatcccagctacttgggaggctgaggcagaagaatcgc

SEQ ID NO: 138766 - DNA, 1023 bp, Homo sapiens
tgaacgcccaacaaaagcgggtagctgctttgtatgccgggatttgtagtccccgacagagtcacttcaagatggcggaattgctaatgacgcgcgaaggggcgggccccgagggagtctgggccgcgaggggattgggtggcgcaggaacttggcgggcgggaagtaaaaaccaggtgttaaaacctttgcactgggaaaggcccaagtctcgcgagagcttggcaggacccaatggaacgtggggcccgacttatcacaaggggcatttgttgggggcggagctttgacgggagcttcccgggagccgtttgtgcccggggtaaccccgttccggccaagccgcttcagcgggggacgtagccatgaaggaagagaaggagcacaggcctaaggagaagcgagtaaccctgttaacccccgccggggccacaggcagcggtggtgggacctcgggggacagctccaagggggaagataagcaggatcgcaacaaggagaagaaagaagcgctgagcaaggtgcccggtcggccgctggcccgggagagggcgggacgagtccgcagcgcggggaggatggctgggaatggggctgccccctttctttctcaggttctccttctatctcttcgcctgaatggaagtcgcatcatcctggttcatccattcacccgaaatggggagagcccctcccggccaaatcctgggtgggggtgaggaaaagaggggactccccaaacgggaagggtttaggtcagagctgtgagatgataatgggagggaagagcgacggtataaagaatgaggaactaaaggtgtaattggggagaaatattaaatagtgaaggagacatgagggatgggaatattattcatggaggcgagttgggggagagtgcagggtgattaatggtacaggagggtagatcgagagcatcctattttgagagcaatgggtagattttttgtattcgttagagttttgaattcttaagttcaatgggcaaggattttgttttaa

SEQ ID NO: 138767 - DNA, 1025 bp, Homo sapiens
acaaataaataaataaataaccaagacagcaaggaacatttcccatatgtgaagcctgtggtgctagctaccagttccccaaacacaacccctctccccaacaccttggctcgggtatattttgtagtacaggctcccaagagaaagaatgcatgaaagtactttgtaaactattaagtgatacagaaatgtgatataataaacaggctcagaggtcttgctttcatcatggctttggttacttcgagcaaattatagctcttttctcaaactactcccacccctataatttatgccaaagtgttctgaaaagaaacacaggcaaaatggttatcctagggctaaaaatcctgattatacctaccttgaagcttttaatccaggaccctacttcaccacccgcctgctctgtcactttctctacaaaggaaggacacgaagtaagacttccaaaagaacaaaacgtttattttttaaatttaagaattatgggaaacctaagtaatgggaattgcatcctcatcggggtcttctggcaagtcggaagcaccaccctctcctgtagctcgatgcttctctagtttagcaatcaattctttcgctggattgaagacgccattggtctgctggtcacagacatagcagcgcggggtggtgcggaaatgctgcagtgcacagctctcgcagaaataatgcctgcacttggtgacaactgggttttggaagctctggcgacagatgaaacacttgaatggtatttcctcatcatcgcttcccacttcatagttttcatcctcatagacaccatagcgaccctcatcaagctcacgttcgatctgccacccatgcttgtaatctgaacggtcatggaggaatttgcagctgtctccgaagccgcagaagccagtctctttgtagtccttacagatgtcgggctggtaatcccagcgcacggtggcacgtagatgctcgggcgctcggatggggcccttcctcaccatcccggaagaggcattgcccataga

SEQ ID NO: 138768 - DNA, 1026 bp, Homo sapiens
gtcacgggtcttctgtatcattggattgtgggtcacccgcttcttttccggtcgaaccacagtgcagccttcgtcgctactgctgccgctttctccgggctctgggtcgcaggccgggcgctttctgcgtccagcagcccctttccgcccaggctttttgaaaaggaaggtgcacacctgatccaccgcctttcctggagaaagctgctctgccattttagagtcctgagctccgaaacagccgtggctgcctgggttgcacttggcccctgcacgtcactccacgttgcgcgctccgccgggagtcgaagcaaaagacactgacggaagaggactgcgagagcccgagcgcccgtctctcttgtgccctagcagattccgtcgcttcttccggagccgtacgtggcaccgccccgctcgcgggcggccgcggggcttgctgggaagagaggcgaagccaggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggtaagccggcttcggcccgggggccgactccacgggctgatttccgaaaagggtggtgggcagggagaccgtcagcctgcgaaccctctctccgaggtcggccctctacttgcttccggttgcctagaagccgaggcttgcgaaacgaagcccgatagaaactacatcctgctctagtgaaaaacagcgtttctgggtgtatcagagtgggccttagggcagagtagcgacgcgggggccgggaaggtagattagaaaaggtggctcaagcctgagaatcgctcactgcaacctccgccttctgggttcaagagattctcctggttgggcgcggtggatcacgcctgtaatcccagcactttgggagaccgaggcgagcggatcacctgaggtcgggagttcgataccag

SEQ ID NO: 138769 - DNA, 1069 bp, Homo sapiens
ccggccacccttgacttttttattccccactttctcttgcaagcctttaggaatttactgcgagatcttgtttttttacatcaggattcattttcccctcttcctagtccttcacatcatctcaagagtacaggatataaatttatttactttttgattttgttattgttcttcacgtgtgatctacagctgttgtttcttagtgtcccaaaagacaacaactagatatttctttttttttttttttaaaaaaaaaggaaaaaaaattcatgttggttaaaatagtgtaaaaagtcacaggtaccaacttaatcctaaagtttagtggtctgattttatttaggagattctgttctttgtactactaatttgcatttttatttaaacgatgattccatttctctggaatgtcccttttaaaaattgtagtatctatcaattgggtcactcacttttataaactgcaacaataattgtctcttatttgaaggaaaaaagggttgctcattttgggtatcactggagtctgatggaaagagataggcgcatctctggagttgatcgttactatgtgtcaaaggtaagatgccactctgatgccagccttttgccagggttgaggtgggttctggtaatgccttgccaagggtcatacagtgctaatatataactagcattttcttatctactagtgaggttggcatctttttacatatttaatcttttatatttcttttttttttttagtttttcttctgtcatatatttcttattctgtggattgttgcctatatcctttgcctgttccattgtctttttctttttgagctatggttctttatatattctagactttaatttttttgtctattttatatatgacatttttcccagtctgctgtttgtcttttttactttatgatgtttttcatcaggtagttctaaattttgatattcaatgtatcatgttttgttgttctggattctaggtttttatgtctcccgtacaaaggccttttctatctaagattataaaaatactttcaaaaaataaaatagagacagtctt

SEQ ID NO: 138770 - DNA, 1052 bp, Homo sapiens
gcttggccaacatggcgaaaccccttctctactaaaaatacaaaaatcagctgggcatggtggcacatgcctttaatcctagctacttgggaggctgaggaaggagaattgcttgaacctgggagatgcaggttgcagtgaggcaagatcgcatcactgcactccagcctgcatgacgggagtgagactccatctcaaaaaaaaaaaaaaaggatccaggtggtaaagagttgcttgactttagttctgattgggggtcggggaaggtttgtttcatataaagcaatatgctgctgtcagaaaatgaaaactagaaatcattacaggttattctttagtgattataaaatttaatccaatgtattgttgcagttagagaaatgtgggatgtggaagcactctttttaataacaatgccatttaatgacactggaaataaaagtacatggcatatctttgatgggaacagacttgtcacattctcctttttaaactgtttttcagggtttggagaacattgattaaggaagcattttcctgattgatgaaaaaaataactcagttatggccatctacccctgctagaaggttacagtgtattatgtagcatgcaatgtgttatgtagtgcttaataaaaataaaatgaaaaaaatgcatttcttttttttaaatatgttacacaaaatcaagcaatctacccaatgtagtctttatcacttaaaaaaaactagaaggcaactgtgaggcttgtatagacataatgtacatccataatgtacatcaagcacctgtctctgtgcctagcagctaatacttcataaattgtagttgctactattgtaatagacactagtatattttatttaactttatttatttatttttttagacagagtcttgctctgttgcccaggctggagttcagtggctcaatctcggctcattgcaacctccgactcccaagttcaagtgattctcctgcctcagcctcctgagtagctgggattacaggcacctgccactgcacctggctaatttttatatttttaat

SEQ ID NO: 138771 - DNA, 2814 bp, Homo sapiens
tacctgagtgataaggacattctgattatactattgtaaaatgcccgcttgccttatatttttaagtggttgtttttcaaaagtgtttaaataaggcagtcatatttcaaagtatagagcaaaagtttttttattattatttttgagacagggtctccctctgtcacccaggctagagttcagtggtgcaatctcggctcactgcaacctccacctcctgggctcaagcaatcctccacctcagcctcccgagcagctgggactaccagtgtgcaccaccatgcccagctaatttttgtatagttagtagagacaaggtttcaccttattgcccaggctggtctcaaactccagacctcaaacaatccgcccgcctcggcctcccaaagtgctaggattataggcgtgagccaccacacccggcccaaagttttataattaaacagtattaacagtcttaaatactattaaatatatgttccaggaaatgtctacttttaacccgcaactactgaaaataagagtcagcatgtagcagcattaatgacccctgaatttgaaatgatttctgtttatttatacctaattgtagttgctgcctagcctaataaatctgtagttttcaaaagttaaaagaaactagttcccaaagttttgagtctcaatccatctacttccctgaataataaaacctgaattttgtaatacccacttaaaaattttattctcagctgggcgtggtggctcacacctataatcccagcactttgggaggccgaggtgggcggaccatgaggtcaggagatcaagaccatcctggctaacatggtgaaaccccatctctactaaaaatacaaaaaatgtagccgggcatggtggcacgtgcctgtagtcccagctactcgggaggctgaggcaggagaattgcttgaacctgggaggtggaggttgcagtgagccgagatcaagccactgcactccggcctgggagacagaatgagactccgtctctaaataaacaaacaaataaaaatgtattctctaaggacattttttttttggttactggttcctagagatgaaatgattatcttattttcagtaggcaaggtagtttaaatgcagaaattctgcgatatatgaatattgtgacatcaagaacagcttcattggcatattctttgggaaagaggcaagaagaataaaagggctaaaagtattttattttcagcttatgagtgttgttactgcttcaaattgtgtttagtcacctgagccataaatcagttgtagtagggctattgtattttaaatatattttttgttctccaaggagacttatctagtttgccacctccttgcctattgctctgatgtggttttccctccttttttatttattgcacaaatatctaacagttaaaaaagaaaaatttcagtaccatatcaattgtctttcatattttgtgttcctcctttccagtgcttttctatgtaagtaaatattctgatgtacttgtaagtaatcactcagagcataatgtaattttgtctttggtgtcttaaaattttgcagccaggcaagagaggttcacagggaaggtaggaacaagtgattattcagtgtgaggatgggaagaagatcaaagataagtaagggcaatgattgtatccttcccgtgtcattgcccctagtccccaagccaccctcctgcaatcatgagtatagtggtgtattgtggaaggcagcatgcccagttttccagtttcaaaatatattatttagcagtgaggcttaactcccagtaaatgaaggggtctgtgagtaggggaacccttcagactggttatattatgagctgtagaactgttgccattttgttgttcccagttgtgcccataaagagatgtgtctgagctggagacttaggctcagatggggaacaaacagccaagtaccaaccttagtttggtccaataggtgaattttagcaactctctaaactcagctctatacctgtaagactcagaagtgatacatatagtgatagaaaaaaatactttagaaaatagaaaacaacttactggttactctgctaatgtgatggaggttgcagaatggaaaatgaatgaatgcaaaaaaatacagctggattgtgtgccacaagtttattactcaataaatattctgtggtttgacgtgctgtattgtatttttaatgtatcctgatgagaaaaacaatcctaagacatcctgtaagtatcagacacgattgaataagaaggggaatgactccatgaaactatatttggcatcagtaagattcttctgccagttttctcgaaagcgaaccattcctggtctacaaaggaagaaaaacaaacacttttaaagtatttttaaatcaaaagcttttaaaatcaaacaaaggggattccctatttactcttttatattcctagtaagcaagaagcctcttttattggcgggggaggggaggtagctaaggttctctatgtctatcctttactgtttcttaagcccagtcaatgaaaggatttatgagcttatatgtaaagatactttaagagagctgctataaaagggattattatacatgagttaattttatgtgatattgaagttttccttagaaacgatagacatgacccactttgcctccaccccactccagcaactaatcctcaagcttataatgaatgaaaaaccagacactaagaaaaataattttctagaacagtttcagcccattctaatgggcttggtggtccaaagaagaaaagtgaccatta

SEQ ID NO: 138772 - DNA, 1142 bp, Homo sapiens
acatatcagggccgggcacggtggctcacgcctgtaatctcagcactttgggaggctgagacaggcggattacttgaggtcaggagttcgagatcagcctagccaacatggtgaaaccccatctctactaaaaatgcaaaaattagccagacctgttatctcagctactcaggaggctgagatgggggaattgcttgagccagggaggtggaagttgcagtgagccgagatcgtgccactgcattccaacctaggcaacagagcaagactccatctcaaaacaaaacaaaaaaaaaggacgtgtcaggcagctaaaatattaataaatgatcttttggaaatttaacccatttcaatttttgtcagctgttaaatagaccactctgggtaagaaaggattaatgatgatgtactatgaaaataattactgagaaattaagccaaaaataaaattctctccaggcatcgccgaatggaggctgtgcgactgcgaaaagagaaccagatctacagtgctgatgagaagagagcccttgcatcctttaaccaagaagagagacgaaagagagagaacaagattctggccagttttcgagaaatggtttacagaaagaccaaagggaaggatgacaaataaagattttctgattgtccagaagacatttttaacaacaaaaaagaaagtctgggttccacacatacatagaaaaagattattatgttctgagaaagctttacagtgctactgtgccttctatttaattctttcagtccttcaataaaaagctgcttattgatataactttagcaagttctttgggttattttggattgaccatagtaactttctggtttaaaaatccaaattatgggctgggcacggttgctcacgcctgtaatcccagcactttgggaggctgaggcgggtggatcacttgaggccaggagttcgagaccagcctggccaacatggtgaaaccctgtccctactgaaaatacaaaatcagccaggagtggtggcgcacacctgtagtcccagctactcgagaggaagaggcaggagaattgcttgaacctaggaggtggaggttgcagtgagccgagattgtgccactgcactccagcctgggcgacaaagcaag

SEQ ID NO: 138773 - DNA, 1028 bp, Homo sapiens
cctttttatcacaaaaatatttaaatattcagaaaagcgaagagaatagtataattaataccatatacttaatcacctagatttggcagttgttggtatttttacatatttgcttcaaatatgggtttttcactgagatagtcaaagttaattacaaatatcatcacacttccaccctaaatatttctgtatgcatcccgtaaaaagaggcattttcctaattagccaccacactatctcacacaataaaattaataataataccctatatcatcaaaacctagtgactttaatttctatgttcatagtacctccctacagttcgtgacaaatagcaataaatgtttcaatgaggtaatttctttgtaacaataaatgggacagcaataggatagttacctactcaaaagtactacggttttagagttaaaaaatttttttcttaattgtaatgtgctttaatttgcagatgaagataacaaaaggagagcaaagaaagccaagaaaaaggaaaagaagaagaaacacagatcgtcagttttttaagttttattatggaaaatttcttttctttttttttttttttttttttttttgagacagagtctcactctgtcaggcaacagagtgcagtggttcgatgtcagctaactacaacctccgcctcccaggttcaagcgattctcatgtcccaacctcccgagtagctgggattataggcacccaccaccatgcctggctaatttttgtgtttttagtagagatggggcttcaccatgttggccaggctggtttcgaactcctgacctcaagtgatcctcccaccttggcctcccaaagtgctgggattacaggagtgagccactgcacccggccagaaaatttcaaatgcatataaaattacataaaatagtataatgatccttcctgcacctgtcatgcagtctaaataattatcaactcatgggcagtatctgccatccatcatttattttggacccaatctcagatatcattccatccataag

SEQ ID NO: 138774 - DNA, 1059 bp, Homo sapiens
ttgttttggtttttttgattcccaagttctgccttaggatctccaatgcttgcttttaatggttcttggacaatcgatgctgttactgaaaaatttggagttcatatctttacactccatggtccatatctcatcactttcctaattcttataaccattttatttaaattcagttctgatgaacatacaccagtggaggatgaagagccaaagaaaagcactacttcagcttctacttcagaaggtatttttaaaaaaagggtatttttaaaatacaagctattttattgagagatttaaaaaaatcagtttgtaaatagttgaacattagactttgcttttactcaaattgcccatcgtctgtttcttttgatgttcagaaatagttttttagaatataattttttaatttgtactttcttagaagaaaaaaagaagaagtctagccgttcaaaagaaaggtccaagaaaaggagaaagaaaaaatcatcgaaaagaaaacataagaagtattctgaagatagcgacagtgactctgattctgaaacagactccagtggtaagaacgccaacagcattctgcaagccttgcttcaaaactagttttacttcttaaaacttattttagaagaaggttcctgaaaacaataataatactgaagagtttttgaacacttgctaaccttgtgccaggtaccccaataagtgctttatatttattattgccatttaatccatacaataactgtagggtacatcttatagatgaggaaatggagacagagcaggttataagtactatccctaaggtcacacagtttggattcaaacctaagcaatctgactccggattgggattggttgtgcaaagtgtacaaggcacatggcaccagaccaagtcagggggttgggctgtaccaaagtaagccttacagggctgcatcggcccagtggaagggctcttttgtttaattctcatgcccaatgagcacctctacagttttcaaaaaggtatgccataaagtgcctacttcatgctggctgcctatttgtggaagg

SEQ ID NO: 138775 - DNA, 1179 bp, Homo sapiens
aggcgcgagtcattaacaaaatttgcgccctctaagctaacacggcaatatggggcttagacaccatagctaatccccagtcgcgaaaaaccctcccgatttgcttgggattggaaagaaaaagaaaatacacattcatactttcatacatgacatacacacacacacacacatttatatataaatacacacagaaagcacaggaaacacaagcagaattaactgtcttgttcatacggccactcagtgaaatgtatactgtatattgtgtttgaaatatatacttcccttcaagtgtttcaagttcaaggctgagaaagaacttggtctcttgcttagacttgaggagcctcactcggaactggaaggatgcacgcaatctagttgccccaccggcttatttatattgatgcacacatcgcttcctgtcggtgacgaccgcctagatccggggaagggttttgcagaagtacccagaactgtgtccaaggtttcctcagatttgggctgttccgcagcggcaggtcccgggaaccaaggcaacagacatcttcctaggctcgcgagagcgcccccttgtcccacggctgctggggccccccagtagccatggctccggtgtccggctcacgcagcccggatagggaggcctcgggctcggggggaagacgtcgcagttcgtcgaagagtccgaagcccagcaaatctgcccgctccccgcggggccgccgctctcgctcgcactcttgctctcggtccggggaccggaatggactcacccatcagctgggtggcctcagccaaggctcccgaaaccagtcctaccgctcacgctcgcggtcgcgttctagagagcggccctctgcgccccggggcatccccttcgcttctgcctcctcgtcagtctattacggcagctactcgcgcccctacgggagcgacaagccttggcctagcctcctcgacaaggagagggaggagagcctgcggcagaagtgagtgagacggccgcactttctcttgtacgagcctacgtgcctttggagtccgatctatcattcattccgcttctgactattcgcatttcgctcactctgcttgccttgcgcccattttcatccctttctttaatccacccacgacaaccctttattcgtccttttcattttcccttaccct

SEQ ID NO: 138776 - DNA, 1018 bp, Homo sapiens
ggccatggactcttctgtgatgttaccgttattgtggaagaccgaaaattccgggctcacaagaatattctttcagcttctagtacctacttccatcagctcttctctgttgctgggcaagttgttgaactgagctttataagagcagagatctttgcagaaattctcaattatatctatagttctaaaattgttcgtgttagatcagatttgcttgatgagttaattaaatcagggcagttattaggagtgaaatttatagcagagcttggtgtcccattgtcacaggttaaaagcatctcaggtacagcgcaggatggtaatactgagcctttacctcctgattctggtgacaagaaccttgtaatacagaaatcaaaagatgaagcccaagataatggggctactataatgcctattataacagagtctttttcattatctgccgaagattatgaaatgaaaaagatcattgttaccgattctgatgatgatgatgatgatgtcattttttgctccgagattctgcccacaaaggagactttgccgagtaataacacagtggcacaggtccaatctaacccaggccctgttgctatttcagatgttgcacctagtgctagcaataactcgccccctttaacaaatatcacacctactcagaaacttcctactcctgtgaatcaggcaactttgagccaaacacaaggaagtgaaaaattgttggtatcttcagctccaacacatctgactcccaatattattttgttaaatcagacaccactttctacaccaccaaatgtcagttcttcacttccaaatcatatgccctcttcaatcaatttacttgtgcagaatcagcagacaccaaacagtgctattttaacaggaaacaaggccaatgaagaggaggaggaggaaataatagatgatgatgatgacactattagctccagtcctgactcggccgtcagtaatacatctttggtcccacaggctgatacctcccaaaatacca

SEQ ID NO: 138777 - DNA, 1103 bp, Homo sapiens
cagctttccccttccatgttagcactttactgctgaattctcaattttcttaacattgagacaataaatgtgtgttttgtcttgtatatggcataaagagtaaataagttttagagttgttctggaaaatgtcagaataagtcagtacttgggttgtgtaatctgctagtccaagcgaacagcaacctcctgctaccctccctctatgaaaatagccatgcagacaagtctctcatctgaagaacaaattagatttagctaattagaattaatcctggctttcattgccatagtctgtaaaagactttggtggctagaccactttataccttcgcagtgtggtctctgggggcaaaaaactaatgaaaacaatctctgtaatggcagataggaggagatgaaaagttctgttgcatggatttttaattctctggctaccacatagtagagaatggaatgaagatttccttttggcttcttaaggttaaaaatattcccatgaacatgaaaattttcaaattttgaatctgaaagccaccaaatgtatctttatgtataaatccttgtaaatgatagattccatgggtgagactttacatattttgggtgggaggctactggcatatatttttaaatgttcatattgcgtagaatctccactaggaagtctttatttgaaatagttgaatcagtgatctagtattttcctttcggcaagatttgttaggtttttaccccttctaaaataagttttattccatctgcaaattgctgcaatattatagtaatcagaaactacataaggaatgttatataggcttgtcagttcccatttttcttgacaacaataaataccacttttaaaaatgacacatatttaaacacttagaaaataaagttaacacttactgaagtgctagtactaaactgtgctagtactaaaagaaaacaggttggaacatacatatagcctagcatttataacagaattgttgaacgtctgtaaatgattttttttttttttgcaaaggaaaaaattgatactggaaaagattgttgtgcatagttattagtcatttgtaaccttgcttaagtatttctta

SEQ ID NO: 138778 - DNA, 1011 bp, Homo sapiens
gtggatgatatcttggcaactgctgacatcgatgtattcgtagtacccaccagtgatctccacccggctggacagggaggagcatgctccagtcagtccccagggagcaggctgtcctccccagccccctccccaactctgggattgggctaccatacagctcagtgaaaagacaggtgggcaggtggggagctacagtaagagacatcatagccatgtactataataaatcaaagtgtgattgtttatccccactccccgaaaaaaaactcctacctgccagaaaaatacttgtaaccaccactaacactaatcctagatagcacttattgacacttgctatgtaccaggcacagtgctaagcatttcacatgtgtgaattcattgcatctgtgctgtttaatgtggtagctactagccacatgtggctatttaaatttaaattaagtaaaattaagtaaaaagaaaaattcagttggtaagtctcaccagccacatttcaagtgctcaatagtcacatgtggctagtgtttactatactggacagagcaggttacagaacatttccatcattgcagaaagttctgcaaatcctcacagtatcctatcaaatagggactatcaccatgcacattttacagatgaagaaagtgaagcacagagaagttaaagaacttgcccaagtcgtaagtggtagaactgggacctgaattcaggcttcaaagacttcagtgtgtgccctctcaaaacaaaacaaacaaaaaaacaaacaaataaaaaccaatgtcctggtaaacaactaaagctgagttgctacacaaaacctgaaagtcgcctccgtggggaggcctttcttgaccactctgtccaaagacaccccttcccagccctgtcgctctctatcacattatccgctatggaatgaattttgtccctccaaattcatgtgttaaagccctatcccccaatgtgactgtatttttagatagggcttttagaagataattaaag

SEQ ID NO: 138779 - DNA, 1069 bp, Homo sapiens
atggcagtcatcatcagttattattaacattattattagtgctgtaggaccgttgtgtgaattttccctctttgggctgtattaggactaggtttgtcccaggattaggcaacactgagtgaagtgaatgagtatgagattgctgatgagaaactcttttcaagccctccttggggctctctcaggcaacaatgtttggctctgctcacagaaatgacatgatgttggacctacagatttgaactgaattatgaaccagaaactggaacaaaccacttaactttgctgtaccccaaactgaatccaaatgttaatttttaaattgaaccatgaaccaaataaaattaaccaaaaaaggtgttgtggaagggagaaaaaaaacccatagtaatccgactggaaatggaactgaccctttttattttattagatgaactaaagcagaactggaacatgaacacattgattcagttggagtccctggagaataaacgacagcacctgtgtgcctgtgatacttggctgttgcccactggctatctaatggcatttgccctgtgtttctgcctccattcctttaccccatccctgtcctaggaatggatcaacagctagagccatccatggagatcaaaagactcagtttcatggatgaagggaaagcaatggaacataggtacattcctttggagatatcttccttttttcccaggatgtgtgaccaggaagctgtagatgggagaatgacactagcagtaagtccccttagcctcacccaggagtgggcgccctagagtttatgataggtgatcacagactgagatagctagctcagccacccccaggtaaaaccaagcacagtccccatttgaacccattgatccctctgacactttctgccctggatgtccaagtattacttgggtctttcctctaggtactctagagttctttcctcaatgccccacccgggcttgaatagaccactaagtaaccgtgctcccaactcttcatttctcccactaaaacaccgtgtcaagtcctgaggccctacacatcagggccttgt

SEQ ID NO: 138780 - DNA, 1044 bp, Homo sapiens
aatgagactttctggggcaaccagagcaggcatcacaggattatctgtaagtggcttgataaagcaaggaaaggagactggactgagatttttatggtggtgagggaggaggctgaagtgaatgttcctgtgcatgggatggggcctgcatagtttgaatctatggccagtaaaaaaggagagagacccaaggctttcttatcaccttgccaagatgtgaggcacgagaagaagaaggggaaatgagctttaaaagctatcagaatttaagctttgaaaaatggaatcagactcttgattacaacatgcttctgatgacagtatggaaaagtgatagaactagggtccttgatcatgttattcaacctctaaaatgaccttggaaccacctgcttcagacttctagggctgcttaataattcaatgtctttatggttgaggatacttttagctagactctgttacttgcagtcaaaagaactctggatgatacaatgttgaagatataatcaattactaccatgttgaatatattcagggaatacaaagacaatataataaattcatcaatgtaattcataacaaaaataaattaaaggagaatatcatagggtcatattaataacatacttaaagtgttttcataaaatccagtaactatccttaataaaaacacaaggtaaagagaagcagaaagcacctacctaaaaactccttactaaaactaacaacaaatatcaatctaaagagtgaaacaataatgtttttaagatgatcagaaattacagaagaatgctattacaattatttcacatattctgtgagtttccaataaatgcaataaaggaagagaatgatatagcataataactactgaaaaagatacaactttttctggtgtgagtgtatgtccagaaaatgcaagagacattaataaataccaatacagttaatacaagtgtcaagattgctggaaacagggtaaacataaaaaaaattctcctatagtaggaataagtggggatggatagaaatgggggaaat

SEQ ID NO: 138781 - DNA, 1045 bp, Homo sapiens
tacctgggaggctggggcaggagaatggcgtgaacccgggaggcagagcttgcagtgagctgagatcttgccactgcactccaggctgggcgacagagcgagatccgcctcaaaaaaaaaaaaaagaaaagaaaagaaaaaaagaatgaattgtgaagctatggggtaagtctcacagaatccaattgcaagaagcacatcttggactcaaaggaatacagaattagattataaagcttcaactgagagaatacatgggtgatgactacaaggaaagtttagggaaaaatgaataatgaataataacgtgcactgcatttgctaaaatgtattagaaagctagaatcaggtgttaggtgggtataagaatagagcaacagttcaaaggacaagacacagtatacacacaaatatatacagcagtatgtacgtgtatgtgtatatacattatgtatatacagtatgcgtgtgtgtgtgtatatatatatatatatatatttggtatttgataaggatgttgttttcagatgagtggggaaagaatggaacgtttaaaaatgatgctgagggccaggcatggtggctcatgcttgtaatcccagcactttgggaggccaaggcaggtggatcactttaggccaggagtttgagaccagcctgggcaaaatagcaagaccctatctccacaaaaaataaaaaataaaaaaaaattagctggccgtggtggcacatgcgtgtattcccagcaacccaggaggctgaggtggcaggattgtttgagcccaggagtttgaggttgcagtgagccatgattatgccaccgcactctagcctgggcaacagagggagaccttgtctcaaaaaaataaattagaaaaaatatgatgctgagatactaagatactaggttagttatttgggagaaaatacacttagtcgcctacctcacaataccaaaataaattcaaggataattagagttaagtttttaaaaaaaaactataaaagatatagaatcaaatataatggctgtttattttatctc

SEQ ID NO: 138782 - DNA, 2755 bp, Homo sapiens
atatgtacacacacacacatatatatacacacacacatatatatacacatatacatatatatacacatatatatacacacacatatatatgtatatatatactacattcttgatcctaagtcttttttaacttaaattttattacttatacagaattcttatttatactttaattataggtgtgacgaagagaaagagagtagggaaatacacaggcagtggttttaagtgtagatgatggctccttaacccagtgtcattagataatcaaacctaaagtcttcccatattaggcaagcgcaattctctattttggacccttcccattcttcccttaccttctgcttttcgtactgaggaatttcgtgtgattttagataaagtgataatgagatattgagcaaataagaaaatagaggtaatgctataaaaaactaagctatgtacactttcaaaatgcatgtttcttgcatgctttttactacttaattgcattctttgctaatttcctttccttgctgtctgttcttttctaacagctgaagaatgttctgctgactctgacctcaactttcttattcctgttgcagtgggtgtggccttgggcttccttataattgttgtctttatctcttatatgattggaagaaggaaaagtcgtactggttatcagtctgtgtaatcagttaaatctagtgtttgtttgtttttttcaattagaagttacgtttccattggctaaaagccaggacatgctgtgcaatagattgtttaagatatgcagactaacttcagtgagttcctagctaacttgggcatgagtacacttatttaagacaaaatatattaggaccaatttttttctgttttttttcttcctttgttaaagtataattaaaagaaaaattgtggcttagaattttttaagtaaataatgattttaagcccctggatccaattatgaaagcatttttgctgatgtgtaattttatatgttacagttacttatattttactactttgatgttatttgcaaaatcaaaggtgttaaagaatttaacttgcttcaggaaataaattcaagaacatagtggattcattttcattggtggcagacacgaaatttggttcatgataagacttcctttccccacctcctgatcagcattatttaaatctgtatttttctgttagttaagaaagaaatggcttcatgatattgtatttaatagcaaaagtttggctgtcttcttcattactgttaatagctactatattttaacaaggagatttctttttttgttgttgttgttctagagtttggaatatactgattatctcagacttgacatttatactgaaggatgaagtaagacctccagctttttttaaaaaaggtgttgatttggaacacctgtatgggttatggtttattaaggttatggtttagaaagtttttttccctcagagccttaacttgttaagaaggttcatttatcctgcactgaaaacaaaaactctatatactttgtttgtgtgcctcctgcactctcccattccctatgtgaatatgctctagttgatatttttaatatattgatttcttttttctcacagcaacaagtgcttactctagaggttagtgggccctgatatgtcatcagtcagatgcctgcctagccaaagctggactaagattattctgtacatttgttgatcttgatatagacttatatccctgtagggactgctaatggctccggcttctggagtaaggtactggagaccactcatccctgtgtctgcttgattggttcagctgttgaattgcccttttatttggaagcagtgttgaagttgtctagggttcaaatggctgctttgtacacctgtcattagtataaggcagatgtttattttatcaagctattttatctctacatttaactaaaaacaaaagttcccaaagatctgccttcacttcagaaattttttttggattaaaaaaattaagcctgaaccttaaataaagtgagttggttattcattccaaggattaagtcccaatctacctctcagcacaatgcagaagctcaccactgtattgctgccattaactcatgccagaaccctttgccaataactggaattacaaatttttgttaaagaaaatttatcaagatctttctttactgccttctctatatgtacatctcaaaaacatgtacatctcaaaaactggagtagaaagttagattgctcaactacaactcctctagaactctatagctctgacatacagattcacactctcctctatttgctaagtatgtaaagaatgttttcttttaaaatgttctcttttgagaacaactgcttatttgttataaaagcatttggttaaaatgatgtcatcataaaaaacagtggctttgtttcaatacatatttttgagatgattatctagaagccagattaataaaatcagcttgtgaccttgctaagcatataaactggaaattcagatacattcaaaattatgggttcatttaaaagtgttctaccttttgggtatgagactaatatcactaattcctcaatagttatcatggctctatcttaattaattagaaaatatgtgtgtttaattctttgagaattaaaatagagaatattaacagagggttaaaaactgcttcaactccaataagataaaggaagctcaaaatctatgagctgagtgttcaattagctt

SEQ ID NO: 138783 - DNA, 3630 bp, Homo sapiens
gtctttccaccttaattgaaacgttccatccttagcttctctggcgccattttctatctgcccttttacatctttttcctactccattgtctatcccacaggtattggtgttcccaagggtttttgtctctgatcctctttttattctacttccccttactgagaaatgttcttgcccatgttttaactaccacttaggttcatatagccacttggttaggacatagtgattttttttttttttttgagatgggttctcgatatgctgcccaggctggtcttgaactcctgggctcaaacagttctcccatctcagcttcccaagtagctaggactacaggcgtaagctaccatgctcaactaaggacacagatatcttaaactcacatatctaaaactgagcatctctctcttccacgtatcctttttaccacctgttccatataactacaaaaaactgaaatgcatatattcttcctcttttatagaatggcaccagcatctacataatcagtcaagtgtggaattggaaaccattctattatctcctcctcgtacaccccctacatccgtttggtcaattttgccttctaatttgatctccagtctgtgccttctgcttttcttctgcacttcattaatccagctcaggacaatattattggttacctggactctagtgataaagatatgtcctaccttactacctccatctgccataacttctgaaatgaaatcctgcttaatatcctgctgctgaatttttttttcatcaggataaggccagactacctaagagcatatagtacctttgtgacctgggtccctgcacactttttctgccttctatccagccaaaaataccttttgatccattgttctagctctgccaacctgcttgcgtttcccttgaagtgctatgtctttttactctccatatttttgtctgtgctatttcttatacctggaatgcccttcccccattacttgcatcattaattcctattcattcttaaaatctcagctcaagtgtcaccttttcaaagtgtgtcttatgtaataaggctgaacttgagtgtgcctctgaaatttttccatggcactttgtgttgcctactcctaccacaacacattttgaaattataaccactgatttttcttgtctgactctaacactagactgagcatcttgaggcaaacagttatgtcatcagggcccacttatatctcttatatctcttttcccattagtaaatgatcccagattgtaatgtattgagttcttatgtctgctttgtatagttgttcattcagtgagttaatacttaacagcaatatttgaagcattgtgcttcttcgacatcataacagtttgcctctgaaagctcacggcctgatcatcaaggcaaggctaattagatttgttcattatgttctgtttaagaaatctgggaactatgtgaccatgttatacatttttcatccaaaatgactgcatttttacttggtacttaaaagtgtattatttggttatttggaaaatcacttttgtggaacatctcatttgctgataatgaaatgccaatgacttgttaccttggtataaaaaaccaaaatatgcgtgttaggaagtgctgtcattttactcaaaatacacagatttgaaagtttgtcactgtttctgttctcaattgtcctttctccacatctagctcaagactgcagtgcagatgacgacaacttccttgtgcccatagcggtgggagctgccttggcaggagtacttattctagtgttgctggcttattttattggtctcaagcaccatcatgctggatatgagcaattttagaatctgcaacctgattgattatataaaaatacatgcaaataacaagattttcttacctctcagttgttgaaacactttgcttcttaaaattgatatgttgaaactttaattcttttatcaatcccagcattttgagatcagtctttattaataaaacctgttctctttaatcagcttaaaatccaaagtgtcatatttactggtcctggagacaaacttgttcaaaagaacatcaacgtgcaatgttttaaggtctatcttaagaagccctggccaaattttgatcctaaccttgaagtatgccttgaacttattaacatggccattataagaataaaatatgtagttgtgtcttaatggaattaataaatgtcatttcactactggtgttctgtttcaatgtataaggactatagtgatttaaactcatcaatgtgcctttgcataaagttcattaaataaatattgatgtggtataaatgcccatcagatatgcttaaacttggttttcagttgaatgaagtagagaatgtcctcaggaccatcagcattttaaaggttatgtgacttttgctgatttctctgagttcaagttaagcatgaagttagtacctcaagcctgtgatttttccctagggatgatacagacccaagaggctacaacagaacttaaactggcttcgtaattagagtttttaagataattgtttgtttttcagcaatatagactgaaaagatccaagcatatttagccacttgcttttttgtttcttgttttgttcttctttggatgcctgattagtattgaaagatagaaatattctatgaactaattaggacagattgtgttgtgtttctctacctcatcttgttgatctctggagcattaaaatctatttagtgttgtcatcagtgtggtacttatgaaatgtaagctaacagcaatctcagaagggaggcagtgaagcatagcaactaggctcttgtttcttcaagatggcccctgtggggcagtgcatagatgggggtgtaaagagaagctgttggcattaaaatgagctagataatcagcccttgttgaagcatattccatggtataagagtagcacagacatgaaacatagataaagaaggaaggcttaatagactagaagacttccacattgaagtattattaacccattgtatgtatataggggcatgatcagagtctctataacttcctgattaacaatacagtgtatcttgttacccagctgtcagtctttgagagctttcagtaaaatatagtaaattctttcagcataggctaatgtgtggttactgagatgagtgttgtgtactcagaaccgtagcaacatttttatgaatggtaaaagtacaagaggaggaaaagttaaaattagaagaaaagtacaagttattgcttaatcataaatcacaccagataacacattttgttaatttcattagctattactggaaaggaccttaacgattatttacagaaaggggagtgaaattcattgaggttccatatcaagtgggcaacaaaactattactagcattttgataaaaattgcccctaatgaaatctagtcactcaacagtaaaacaacagctggtttacacttgaaattatgagatcagaattgggcactttgggcttccgtactatgttttgcttaagttttttttttaatactaatatgggctttttcagtagtaatataccaaaacacttctattttaatctctgtttgctacttcaaaacct

SEQ ID NO: 138784 - DNA, 1656 bp, Homo sapiens
tagtggtgtgatctcagctcactgcaacctccgcctcccaggttcaagcaattcttatgcctcagcctcccaagtagctgggattacagacgagtgccaccacacctggctacctttttatttttttagtagagatggggttttgccatgttggccaggctggtctcgaattcctgacctcaagtgatctgcctacctcgacctcctgaactgctgttattataggcatgaaacgctgtgcctggcctcaactggtttttaagagaagttttattagtttttgttgtaaatgtatacctcagctttccagttcttgtgttgaaaattgtgtttgaaaaatgtctgaactggcagaaaattgaagattaacagcatttttaatctacatgaaacttcttactgaaattttagtggccatggaactttttaatctttaaaaatctttattgcttctgtggctattaaattcttctgcaaatacacttctcttttccccagaagcattttcaatacagcgttaagtatacattaggcaagtagatcagatcaaaatgacttataggatgagattttcttttcttcagaatgtgatcccattaaagttactgttttaccaacattttttccattaactaaataatttttaaaggttgaattcatacaatcaatagttattataaattaatatttcacatactaattgagagcattttaagtaaatgacagtatctagaaagatctttgtattagcggaattgcctttttgagctactctgagaatatttgtcttacatgaaagccttattggcagtatttatgaaagtcgtttcagtactaggtcaaatacccaatttgggaaagagagaactatgagtctgttgccagaataagaaattaatctactaatgaatttttaaaaaaccaagttatattaaacccacggcataatactttatggtacatgtcacctaatagtttatgggctgggtggtaatttgggaaattgtaggggaggtgctaactggggattcttaacaccatctattcacaggtcacatctggcagcctcagctctctggattcttaacagaaccaagaagcaagtaaaacaaataattgaactggcagcccaagtcaatgtcagaaaagtttataaactccagggttgcattttgttcctagttattgccccagaggctagtgggggcggcggggaaagcttggcacatttcttgaatgcaagcacaatcagaattgccatgcagcctatttgtcctatctttgatacaattctaataagcttagttatctgatttatcagtccctggtagactgcaagctaggcagagaactagggcaacaagacacaggaaatgggaaatagaaatagcagttaacttctttcctgcaagtgtatccatctgtagcattccttcctcctctccagtctcagagtaggttttcttttcctggttaaactgaggcaaacagttatgtcatcaaggcccatttatatctcttttcccattactaagtgaccccagattgttatgtattgagttcttaatgtcttacgcttttggaattcaatctcttaacttgtaggagaacttgtaccattcagcatcttctgtcaattgctaatggctgtttccc

SEQ ID NO: 138785 - DNA, 5547 bp, Homo sapiens
attacaagattaaaatttgcatgaagaaaaaaagcacataaaattccttaattgacttgtccttttaagcctattacctaaaattgggggtttgtggatcacaactctgttgagcagagctagctattccaggcatccacatccttttcaaccattaattctatggtttggaaggaaatgtggaagctgtgtttaaaagcgaatatactgtgagccattcgactacttttgcagtggtgttgaatacctagtctgacttggttaggccacaataaattgggctctccaccctaccattcttgcgattaaagacgttagttacactttaaaaatattttcaagaattcattttcccttttgtctgttttgcttatgtacttcaattattttgatcctttagtagctttatttttggactttttatctggctccccttcattattcccctaattttaagtccagatttgtgtttacagtttaaaatcgtttgcagtattagtatcatcacttcaagactgtttatctagtcacctgtaatagagatgagctgtgctctttctcttactttgaaactttggtttttatgtacatagaattaaaaatatcacccaaagagatatacagcatttaatactgatattgaatgtataatctatttgtggaactaggttcttggctgtgggtacctataaatacaacacataggtaatatttgactgtatggggaaagaaatagaattgcaataaggcagaagagtgttgattggattttactggatcagaccactttctagaagtagaaaaaaatagcccccttaggctgccaaccctgaccagataagaaatgcagtaagcacgctcaaattagtaagaggtcccagttttcttgactttgcagccactaaaattgtatgtactaagtcacgatctgcaaactttaaagttccaaacagtgagtgttttaggctttggtgccatatggtctctgtcacaactatttgaccctgctattgtagcacgaaaacagcaacacataaacagatgactgtggctgggttccaataaaaccttatttatggacactggaatttgaattttatatgctctcatgtgtcacaaaatatttttttcaaccatttaaaaatgtaaaggccatttttagctcttggaccagatctggcccatgggctacagcttgctgacccctgaccctaaagacagagccagcctggctattctcatcacatgataccttcctgatcctgtttccactttcccaaaagacattcactctaccactgagaggctaatctggctatgtaaaagtgggctagattagctccctttatttctgataaagtaatatgcctattttggaaaggacttggaatataaacaaacatatatgtgtgtatgtatatgtatatgcacacatatatatcacatataaaatatatatcatatatataatgtgtgcattatatatcatatataatgtgcatatattatatatatgcacacatatacaatgtgcatataatatatgcacattacaatatgagctgtgtttatagatgtaaatgaatatacatgtattcatatatatgaatatctgcatatatacacataaacaaatgaaaggacaaagaaagtcttagaattttaattctagaacagttctccattttctatagctttatcataaaaatatacctgtcttagttacttgaagttgatcttgtaagaacatttctgacttttaaatcaacatctttgacttcgagacattcttttgtgattatactcattatttattacacactttttctcacctacagcccaagagtgttcgctggatgatgacaccattctaatcccaattatagttggtgctggtctttcaggcttgattatcgttatagtgattgcttacgtaattggcagaagaaaaagttatgctggatatcagactctgtaacactaatcaatacgtgatctctgttacaaaagaaaaaagcaagtacaagttccaacatgcaatactggtcaacttaaggtatatttagttgcagtccagctctttagaatgggtggtatgggggatttcaaacttaaacaaaaaactatcaactacaaattagttgcctgactttggtttttccaaccaaggaatttaaaactgttatttttacagcaaaagatgtgcaaaatcactggattataagttctattttactgtcttgaattagtatttcagtgttttcattttagacattcagactaaaaatacaccgtttagaaaaaacaatttttgaaaaagagattttttttccctgcaggtagttgagttggaacaacatgttctaccgtggatttgtacttgctccttttgctctttttgtgtgtgtgtgtgtgtgtgtgtgtgtgtgtgtgtgtgtgatttttgtttgcaggttaacttagctactttggcattgctgcatatttgacctttgagagatataatagtagatttgaacaggggctggtattattatgttcttagcaataaatgcttttctaatgccttttgaatacatttgtatttatgtggctgtaatgacaaaagatacaaaagctttttaaaatttagagtaggtattaatcttattgtttaatcttttttttaaaaaaactggatatttcaatcttttaaattgcaatatataagactattccaactgggcatttcaatccattttttaggtgctttagagataattgcttgccagtgccaattgagggcattagtactttgtgctcataaattggcctctgtatgcagtactaaaattaatgcagatttctctttagccttccaacatttcttgttgatagtgatgtattttattattttctttttcttaagaaatgccagtgtgtcctagaacctagataacgaagtgcacttacacttataaaataacttgcatctaggctgggcgtggcggctcacgcctgtaatcccagcactttgggaggccgaagtgggtggatcacttgaggccaggagtttgagaccagcctggccaacatggtgaaaccccatctctatcagaaatacaaaaaattagctgggcgtggtggtgggcgcctgtaatcccagttactcgggaggctgaggcaggagaatcacttgaacccgggaggcagaggttgcggtgagccaagagcgcaccattgcactccagcctgggcgacaaaaacgaaactccatctcaaaacaaaacaaaacaaaacaaacaaacaaacaaaacttgcatctaaccaaaaagtcttggttttatcttaatccattaaaaagttgttctttgtttccagcttgcattgattgctacaacatcactaatttggctttcacatttaaatggttctgtgctaatcaaaactttcgttgttattattcattatggtagaatcatttttaattcacgtgctttgtgttcagttttgtggtctgagagatgtaccaattgtcaaattaccgtgtaccacctaatgtttataggagaaagcaaaatacatcagcttggtagttaacacatcaaatatttcttgctgcttctaggagaacttttttggtgtgtgttggaatggctgagcaaatattaaaattgttaatatgcagccatatatggaaggttcctgtggggttgttttttcgtgttttttttttttttgtggtgggattatgtgcctcccattcactagaaaatgagaaaattgtctgggttccaaaatattgacattgaatggatcaatacacacacacagacatatatatatatatgcacacatatataggcagttgcatgctagcatgggtatttttataacaatataactgagttatattggaattataaatattttccgtcacttaaatttgttctttgtttagcctgaaaacctttatggctcaagatcagattcctgactaacccctctcttagagctacagcgagctgcattaccagcttaaaacacttcttagggattaaatatagatgtaatttttcaaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaagtgcatggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatgttctttgtaccttttgtagttttatttgtattactagattcataccttgatggtaacgctctatctggttttgggtgtttttcatgttttagcatttgtataaagaaactggtccatgtaaatactttccatgttttttcttcaaatgtttaaaccactagttgatgtatggtatctttagatatttgcctgtctgtttgctcaaaattgcttctaaaacaataaagattcttttatttcttaaggcaatttgcttaccttttttcccgttggttaaagtcaagattttgtatactacataatggcaatttctttcaaatggaaaaactttagaaatgtttagaagtagaactgaattatttgcaaaatgttctgatgttctgtctgtatattaccatctggaagaatagtcccatacataggcctcgattgatgctaggcaggctacagaataagatcaacctgggaagcgttttataaaaatagattccaggctgcatccttagaggatttaacgtagtaggtctaatgaggagacagagagagagagagacagagagagagagagagagtgtgtgtgtgtgtgtgtgtgtgtgtgtgtgtgtgtgtgtgtaagctcccctgctgaacctgatgcatagtcagttagggaaccagtgatctagaatatttatttcataataaaagctgcggagtatctctttgtacacttttctcaattcctaagttgaggttgatattcaatatctctacatagtagctttacattgcagccatacatattgagctattgatctgaaccaacgtaggattgtgtgcagtctctctcttacttagatcactctaaaatacttgagccttccagtttccatatacggatagttacctagtcaccttactatatcacataagaaaacttagcaatgtagctggtaacttttctctgaattacccagttaagccatgtgaatgccagttagtcatcacggctgcaaactctgcagttaactaccattgtctttggccaagttgtttaacttctagtgtctcaatttcttcatccagtgggtgggggctttaaaatcctgctactcatttctttgagtgataatttgcatttcagaggaatgcatcatagtatttcatacatcttagtat

SEQ ID NO: 138786 - DNA, 1506 bp, Homo sapiens
ttaagaacagtgctgggcacttagtaagtgctcaaatgctagcataaaaatttgagattatgcttattttctaactaccgttatttatactcttgctctctcaaataccccttttcccacttgtttcctaagagaatcctgcccggttcaaaatgccccatccctaagctggcattactttttctcctcccttatttggaagtgatttctctcctattttcatgacttctcactttcttttttgtaatatggttgtttatgtgtttatcttaccttccctggcagattgcaaacagggtgaaggcaggattgaagtgtggttcattttggtagctcctggagtacttgcactctgaaattattagaatgactggctgatcagatgagtacttcagaaagataatagcagtgaaaaggaaagattaggactggaggggctgaaaggcagggagcccacttaagaggctgctgtgatccaggctagaggtggtgagggctcagcaagtgacaggaggaataaaattgaggccataaatcttcaagtgtctgagatccacatgactacacctgtgctccaaaagttggaaacaaaatacagaggaaagggatttctgtcagattatgagttctcttttacttagttgcagtttattctaccgcatgatttcttcttctgtgtaatagtgttagattgcttttcttctgtgggtattaaccgtatctgttatctgtagacagttgtgaaatgttaattaactggaagctctttttcaaacagaaaaatgaaaaccgattttatctgaaggaagtgaacatcagcatgtatttggttaatggctccggtaagcaaagcactggcctggggaaaaagactgtggattaccctgaaggattagaaattacaatggtcttattaccaaatagtgccttatttaatgaaacagaagatgctatgtaaaaagtgtaccttgatcataccttaaaatcagtaacttagaactatgatgttctgtctttttctgtatcccattttttcaaagtagagtagataataattaaggatatgactgatttttagactatagaaacatctatagaaagataagggaacctagttatggtaagaattgctttttgtgggttgatcttgtcccccaggccttcactgaaaaaccctgaggactgttcctttttttttttttttttttttttgagacagggtctcgctctatgcccaggccagattgcaggggtgtgaccacagctcaatcccaggttcaagccaactacccacctcagcctcctaggtagctgggactacaggtgtgcaccatcatgcccagctaatttttttttgtattttttgtagagacagggtttcaccatgttgcccaggctggtcttgatctcctgggctcacgtgatctgcccaccttggcttcccaaagtgctggaattacaggcgtgagccactgtgcctggccaactttcccatttttgatgttg

SEQ ID NO: 138787 - DNA, 1460 bp, Homo sapiens
gagctttgattagttaggagttactataaccatgatgtgttaatgtcactttcaggtgttgtgttggccggcagaaaacctagcagtttaaagtactcttgggggtttagattctatttgccatcagtggatcagagtacaaacaattggcctttatttcagtcagtttaaaatataactccttcacactttgatctgaaatgcactgtaggttggcgtacaggagtggcacagctatccgtttctccagctatttgattactcggatcgtgtagacatgcccgagtacatgatggcacttctagttgcaatgttccactcaggctgtagagggattgccaagaaacaaatccgatttccaggatcttgtgacttaaacaagcgaggcagatggctcttgtgctccataaaaatgtgtgttttcatttggctcattactgtagaagcttccctcttgtttttttttttaagttgtctgagtcatagcttgaggacccatgccaactttgtttgaaagtgaagacaccatgaattttaagtatccagacaaaagattttttgttctacgctgaagttgattttgtttggtagagtgtaaggctttgctggccacttttatagctaacctgtaccttttccctttcttcttctcctgaaggttgcttcagttattaacatcaaccccaatacaactcactccacaggcagctgccgttctcacactgctctacttagactcaatagcagcaccattaagtatctagactttgtctttgctgtggtgagtaacagattttttaaagttaggttcattctcttagaaacacatctgaaagtctaaatagttgcatggggggaggggggtatttagctttattttccagttctacagtactcaattataaagtgtagtccattcatccctgttcatccctcagagtctgtgcaatggtctgtggactggactcttgcattaatgttcaccaagagtggccattttaccattagagagactctagggtagaagcaagaattaactcacatcaaaaaaaagaaaaaaacgaaacccacaattgtctaatctatccatacataagtaatttccatgataattttttctctgttattggttaggtagtgctcatgtttttctgtgatactatttgaagccatttggaggctatattatttgtgatagtgtcagtaataaaaataggtaacatctattgagtacttactatgtacaaagctctgtgttaagtgtgtatatgaattcattaaatcaggacaatttataatggcagcattcaggtttttgttgttgatcaagagctgaaacctaaacagaaggttttgggttaagcatacctgttctacttcttgctagcataaattaatcatcggggatctttatttccaccttctcagaagcaactattattcccataatttctgtgaag

SEQ ID NO: 138788 - DNA, 1134 bp, Homo sapiens
ggttcatttgtatttaagtcctttgatgatttctaagcttttttctagtaaacagtatccttccttatggtgattgtatgtgggaataaagaaccaaaaaatttaagacttaactctctgaatttcgtatcagaggcaggcaaagttctttgggaataaaaagatttaagggtctgaaaaagacgagtatgtggccatgtgggagcagataaagcatagggatgtgtcctgagtttgctgtgtcataactcatgtagatattctgtatatgaagcagcagtttaagaacctctgcctaatttagtttcaaatatactaacaagatattctcttcccctaatataacccttttggacttctattatgagaattttttttggttttccctggccttatgaattaagaaaatgtccgctttggtttcttttgtcccttttcgcttgttttagagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggtataggtgtctatctttatcaatacatcctttttgcatttcatttcaaatattgcgtatcctaccttcagcccaaaggtagtgttactagaatgattccgttttctttttgtttgtttgtttgtttttttgagatggagtcacgctctgtcccccaggctggagtgcagtggtgcgatctcagctcactgcaaactccgcctcccgggttcacgccattctcctgcctcagcctcccgagttgctgggactacaggcgcctgccaccatgcccggctaattttttgtatttttttagtagagatagggttttaccgtgttagccaggacggtctcgatctcctgaccttgtgctccgcccgtctcggcctcccaaagtgctgggattacaggcgtgagccaccacacccaggtttttctttcttttttttctgagatggagtgtcacactgtcgcccaggctggagtgcagtggcatgatcttggctcactgcaacctc

SEQ ID NO: 138789 - DNA, 1051 bp, Homo sapiens
gaatttgagtaagcggaggattttgagcaggatgtttccagcagggggaagcatagcatatgcggcagtaattggagagctgcctgattaaatcaggctgtgtgtgtagcagaaggaaaataaagttggctaaatgaagtgggcctaaattatagggggccttggaagccaaggaaagacatttagcttgatggggcaggcactggggaatcattttaggtttttaaagcaggagaatgatataacaaaagcagagacagtagcttataaagaatattctgcaggattagttgagaagtgaggaggctacaagcagagatgctggcttaagaagctgttatagtaatcaagggctgatgtaataaatgcctggactacaggggcatcagttgttagcagttattaggaggaggtgtttaatctgacatatttggatagaaaaactatggaccctgaaatgttaacacttctctctttccccttttatttaaaacaaagggaggattactttttaaattactaccttctatataataatatttgaaactatttggaatgttaaatggcttcctgaaatggactattaataattgtttttgatatagttcagtgtttcaagaatactaatttatggctgggcgcagtggctcacacctgtaatcccagcactttgggaggctgaggctggtggatcattggaggtcaggagattgagaccagcctggccaacatggtgaaaccctgtctctactaaaaatacaaaaattagccgggtggtagtggtgcgtgcctgtaatcccagctactcaggaggctaaagcaggagaatcgctttaacctgggaggcggaggttgcggtgagccaagattacgccactgcactctagcctgggcaacagagggagacccttccttacccacccccaacaacaacaaaaaaaactaatttaggccaggtgcagtgactcaacgcctgtaatcccaacactttggaaggccaggcagatcgcttgagctcaggagtgtgagactagcctgggcaacatagcga

SEQ ID NO: 138790 - DNA, 1062 bp, Homo sapiens
catctcctcttaattcctttgccttcttattttctttttgttaaggtcctcactacttacaacctaattttttaaaaaatcagtttaagaacagcagctcaagccagttttccttttctttttagacatacacgaatttatccagaggagtggtatgtagcagaagaatcagggactggtttacacagcaaaccaggcaaagggcaacctggccatggagaatgtatgatttaggctgaagtggcatgccctacataaatgcttggtgttccttgctgcctgtttgtttctcacccccaaatttctatttcttttagaaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggtaaccttaagaatggatttgtgttatgttctcttgctttttattaatgataaaaatgtaaacaattttaaaattgttatgaatgtctgtcttcctaactagcatggaaacttcatgtctttataaccctcccactgaccccatgcatggcacatatgacaccatccaacatactgatgatatttgctgtcattgcttgagtgacttactgtataccaggtattatcctagtatacagtaagtcaccttactatatatatcctagtatacatatatatgtgtatatatatacatatatatgtatatcctagtatatatgtatatatatatatacacatatatcctagtatatatatacacacatatcctagtatatatgtatatatatatcctagtgtgtgtgtatatatatatatatatatcctagtgtgtgtgtgtgtgtatatatatatatatatctcctagtatacagtaacacacctagtgtgttacctgcagcatctcacttaattcttaacagcaaccctggga

SEQ ID NO: 138791 - DNA, 1052 bp, Homo sapiens
gatgacagtggattgctcagatattattaaagagtatgcaagtatcttaacaggaaacagcttaccctttgggtaatgtgtgatacagtgaagaaaatcccttaaatggttgcccaatatttatgctgctggcatgtttgctgggatattttttctcctctgaattagtattttgagtccttgggctcttcagtttaatagataatgtttctatgtttaagtgtagaagatccaccatgttagctgaaaagttccaaggcttttctgtctctgtaacatttctctgcctaaagaggtagcaggttgaaaatttaggaaataactttgcgtcaaaaaattcatcagcctttctaatcaattcgattttaaagtgaaacagtgatgaactttgcatttatcagaattcatgtttttctcatggatttaacagccctttgcaactctgcttccttggttacatgatagaaagagtatctgatcacatcagaataaaatcgtttgggaagacatccgtgtgtcatagattatgtagcttgcaacaggatttaaagcaaaaagatggtagaatatcggatctatcattatttttgcagtgaatgtttcaccagctggtttgagagaagttttacacccctaccaggcttcctcttacctcatttaccgcaaaaaccacaagtcctaacaggcaaactgtaattgcctaaaacaaaactagtaaggtataaatgcatgtggaaatgattatttgaaggcaaaaggcaaataaatgtcaccagtctgagccatgacctaagcatcctaggtctagtaaccattcttttggtaagggataatgccaacttttttatcaataggattctgttaaaaatacaaagaaaaacagtcagcaggatactgtatctatacacatacatatatgtatatacacatatatgtatatatatgtatgtgtatatatagatataaaatacttttgtttcattttagagctggttgaacttcagtggtgggtagagcttgtttttaatttatataatttttgtagtacaatt

SEQ ID NO: 138792 - DNA, 1920 bp, Homo sapiens
cttgacacaggtggttttggtttgtgaaattatttgagctgtagacttaatgttacgtgcacttttcccttacatctgttatactgtgcctgtttctgtacatatgttacatatcaaatgtttattaaaggggtatattgggtaactcagaatttctggtgctcctggctatatataccaaatcccagttcaggattcaacaacccagatcatgctgctgaactgcactaccactgccaagtgtgaaattgaagcttgctctgctggccttgttgcctgggagcttgatcctgcttctgttactccacacctgtctccctccctgttccattcctggctccatttgcagccctcctttcaaagtgtggggtggatacctttgttaggcagagcctagcacaagtggtcctccttactgcaagggagtctgggaaagcaagtatccagtgttttcagcttttatagtgggtggtgatttctgccagaaattgtaacaaggggacaaggggtgtttcagatttggggcagccaaaaagcgagcaaaatccatctttgaggtgagcatttaggccaatagaagaaagtagatttcaagtgttaggaacaatagaagcccagggtagaggttgaatagagtatggcatttgagcccagtggaaacaagtttaactggattaaagggtgtgctctgggaaaatagtttgagaaaagttgaaggaataggatgggacaagattaaagattactttgaaagtcaggcagaggaatttaaatttcatatgggaatgttggagccagtaaaagtttttgaacaagaaagtgtcctaaaaggaaatggtacttaaggattattaatctggcagcacttctaggggtatctaggcattttctgtcataatttaggtgtggggtgatagattgggagtagaaataaaagacaaagattgtatttaagagaagatttgaaggaaaaaaatcaataggacttcttgaagagaaagaagtagaggctatttctgaaactgagcttgagtgactgatcccactcttcatttagagctagcaaagctgaggagggacccagtttggaggaagcagaagaatgaattttagtttgggaattgctgagtttgaggtgagagatattgagtaaaagtggtccctgtgcagttagagttggggaccaagaagtggaaagaattgcactcaggcagaaaggctgtgaagggaatggaacagagtgtgccagaaccctcagggtgtttctcagctcttgtttacgggccaccaggtatactatcttgaatttaattttaagtgatacgtttgaaccacaacctctaccttttgtttcataaaacgtcagttctcacaccctaagacacattgatgcaagctatcgatgctattactattttacatggtcttcttcctgttattctaatatatttggaaagaaaatgattaatacatgtgaggcttttcttggtaattttcaatacttttgaatgttttgaatacaaggagaataatatactaaagctagagaccttaaacaagaccgagaaaagactgcatataaaaagcaaacctccagttcattaaaattgtaagttggagctcttggctccatggcagggagccttggatcagtaagtataacagctcccttccgtattgtacttagaaaagaatgatcataaaacctacttaggcctcacaaggtctttttgagccttagccaatgcatttagtcactgtcagtaaccacaagctttagtataatattctggcttgcaaagcagccaggtctccagagcatgacgataggctcttctatacaacttgaaagctgttgctgaggcataccttcttgatattcctcttagcacttttctctagtctatagcaagtctgtac

SEQ ID NO: 138793 - DNA, 1325 bp, Homo sapiens
atattcatctatggttttttaatgtcataaagccttttaaaaattgggtattgtaaaatcaaacacagcaataaggatggaaattgcttgctagatactttttaataaagtgtaaatatttcaactgtaaacttaccttttgggaaaagctctgttcctagcttgacatccatgtcaaaatttattgaagtgaaacccaacatggggtttgagggaatatccagaagactgatatgttcaagatttggaagagctaaaggactggcctctctgtaattagattaagctatgttttgggtccctattgcagtgtgttttcaccttgatataattaatcagtatttattgaaaatctaatatgcattcagcactacttggaatgataggagatagaggaaaagtaatacacatggtgtcccctaccatgacactcatgatagatgacattcatataaaagacacactgctaggggttgtgggatacatcagatcatctgatcaagggagcatactggagttcaaacgagtgacagaaatgttatctaaagggaatcttgaatctatccatatatatcattcattcacagacttggtactttttttattagtaacaaattacttactgtatactataatttaccatggcacaccagtttgttatgaagtgacagttgaaaactgctgtgttggagcttatgacagtaggagggacaggatttactgctataaaataactgaataattcaggataatgtaaaatatactgaaatgggatgtgcattattactgctccttgagggcttttatagtcagggaaagctttgtggagaaaatggctactgaaaaaacagatagcatatcagcccaggttcttaattgcaaggaagagaaatacaatctgattgattttaagcagaaaagaatttattaaaaagaactgggatataatgcataccctttggccccacagtttcattcctagatatacagccaacatacacgcatacatgtgtttactaatatgtgcaagaatgtttgcagcagtgtttgtaatagaatcacactggaaactaaatgcccattaaaggtagcatagataagtagtttttttgtttgtttgtttttgtttttttttgagacagagtttcattcttgttgcccaggctggtggagtgcattggcatgatcttggctcactgcaacctctgcctcccgggttcaaacgattctcctgtatcagcctcctgagtagctgagattacaggcatgtgccaccatgcccagctaatttttatattttcagtagaggtgggatttggccatgg

SEQ ID NO: 138794 - DNA, 7549 bp, Homo sapiens
caatgagaacacatggacacagggaggggaacaacacacacgggggcctgtcaaggggtgggggccaaggggagggagagcattaggagaaatacctaatgcatgtggggcttaaaacctagatgacgggttgataggtgcagtaaaccaccatggcacatgtatacctatgtaacaaagctgcacattctgcacatgtatcccagaacttaaagtaaaattaaaaaaaaaaaaaaaaaagaaagaaaaagaaaaagaaaatgccgtccgcgcatatctctcaggagcataggaagggctgtgaaccaaaaagccagggcgtggtcgccccgcccaccggccgctacatcaccacccctctcgccgctttcaagcgcggagattggctgtaagcaagaaagagccccgcccctagtcttatgactcgcactgaagcgccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggtgagttgtcgggccctcccgattagtctgtccgcctgggcccggggcaccagttcaaagctacaacctgaaagactggtccgagggggagggggttgagaggctcagcagctaacactgggcggcggcggttggcccggggaggcaagcggtgacctagagaaggcctgaccgacggatggcggggaagaagggcccaggagagtaagaaggggccggtaacggggggtggacgccgagggagtaggctgggaggagtgaagcgtggagagggtcagcgtggaaagagtaacttggggaaaacactgaggagtgagcgtaggagggtggtacatgcagattttgggcgccagagacaattaggagagtcttggtttgctgagatcagggaagagttttgaagatggtggaaaaactatggggtgagataggaaattaagagagaagaccatgcctgcctggagtagcttgggagaagtgtgtgggtgggggacagatgggacagataggacagtagagcctgaggggcaggggcagtgacagggttgggcattttgaaggttggaatttgagactgtgaagaaaggatgattcaagagattaggagtgatgctgggtttgagtttggtagtcatagttttaagggcgaaggaacctaaggtagctggggcaatttccaggaaagaaaacttggacccaacctctggagactaaggggttcagggggaactttgatggggagtgcacatctgacttggaggtattgaggatgtcgattttctcccagttttgctacttcctcccagccagacgctgacaaaaaaatccccagacgtttcagttaggagggcctcccagatgtgaggttttgggggtggagtatttgagtttggtagactacctctttgccttcagagtttcttcttttctttcttccccatcacacagctagcctattacctcatattttgggggtgcagggagcaggtagacaaacttgctaaggattgggttgttaccagggcctaagaatggctggatggggccgggcgtggtggctcatgcctgtaatcccagcactttgggaggccgaggtgggtgtatcacctgaggtcaggaattcaagaccagcctggccaacatggtgaaaccccgtctctactaaaaatacaaaaattagccgggcgtcgtggcacatgcctgtaatcccagctgcttgggcggctgaggcaggagaatcgcttgaacccagaaggcggaggttgcagtgagccaagattgcgccattgcactccagcctgggcgacaagagtgaaactctgtctcaaaaaataaaaataaataaatcaataaataaatggctgggtgaatgttcgctgattgtgttgtgccctaataggcagtgggtcgctaacaactttaatgcctaaaagtgaactttgactaaagtgtctcttcctgactttgattcatgctgtgcttgttgctacccacctgctcttgctatttgtgacttaataaaataacataaagaacagacccagatgggagtggggaagaaatagacatattaggggtctgagaaagcagtgagaggtatacattttgtaattcacatttcagtagaatgaaatcaacaccctggaatagtgattctcaaccaggggacatttggcaacatctggagacatttttggttgtaacaactgggggattgcttttagcatctagtgggtagaggccaaggatgctgctaaacatcctaactaagcacagggcagcccctgacaacaaagaatcatctccctgaaaatgtcaatggtgccaacattgataaatcctgctcgaaaaccatagtattggaagggttcttgattatctaattcagtgactctcgaggaccttttcatgcgtctgtgaaatcaaaacttcggaataaggttaagaaggtatttgtccttttctgctgggcacagtggctcacgcctgtaatcccagcactttgggaggctgaggcgggcggatcacctgagatcaggagttcaagaccagcctgaccaacatggtgaaacccagtctctactaaaaatagaaaaattagccggtgtcgtggcacatgcctgtaatcccagctacttgggaggccgaggcaggagaatcgcttgaacccaggaggcggaggttgcggtgagccaagattgcgccactgcattccagcctgggcaacatgagcgaaactctgtctcaaaaaaaaaaaaaaaaaaagaagttatttgtcctttgtccttttcactctcatcctctcaccagtgtacagcagagttttccagtggctacgtaacatgtgatgacctcaccactctgatgttcttatattttattcatttctcagttttaatttctaatactgtaaataccaatacatatgactcacataaacctctgtgaagtcctcagtggataagaaagtaaaggggtcctgacaccaaaactttgggaatccctgatgtagtccaactgttcacagcgcgcaggaaactcttctgtagcacttctgaaaggcggccttgaggcaggctttgcttgaatacttaattggaagccttaactgtaccttggagcacttactgagggccaactgaccctaagaaaggattgtttacaatggaaagtaccttatcagtgactagaacacatctgaccaaggcatctgttaatcagtagttccctgccaattgaatctgtgcacaaatacaacactgttattgttttgggaaagtgaaaaaaataatagttgtcctacttgttggctttcatgtcattaaatttttttttgttttttaatgaaagcttttttgttttgtttttacaaaagcaatgcttactcactgcagaaaataaacatgcaaaaagaagcacataaaagaacccatcagctcatctgctagtttgccatttattgatcaggactaactagattcttcctcttggaaaatttccaagattgattccctccgcctccaagttcagagcaggatttggaaaagtaaatattaataatgtacctagatctgatttttaagaggttccaggatgaaatagaaaccatttttctatacagctgcattttctgatggctcttggttcagtgtggagcccaaagtcctcccatatagctttttctgtcaagaatttagcagttgcttggtgggttttgcacaagttacttttctatatcaaaatggataccaataataggtttttgaaaacttaataaatatttgtaaagtacctaatatgtagctaaatcaataaatatttgtaaagtacctactatgtagctagaactgtgcctgggtactgtacggagtgccaatgaaggaggacctgtcctaaatttatagtcttattagcattagtgctctagctgtgccagtttgactttgtaactttataactctatcccagcttcacccataaccttttaaaaacagcagctttagaataagtacagaaaaggattcttagaggctatatattggtctttttcatagagattaaattatgctggtgtttatttggatgaattgtaactgaccagacaactttccgaagagaagctatatgatttagaggtgttataaagtggatagtgggtgaaaatcctttctttatataattgcctaattatggtccttttgtgatatcatagatttcaggattcttctgtggttattgattcttataactagcttgacttctgttttttggtttgtttgtttgtttttttagggttcagaattttttttttttaggtttgaggcttttctgggtgggaaaaacctcacagaaatattcttagtgtatgttactggtaggagcctctcccttccacacgtttactgaatgcctattgtgtcccagccactatattaggtgaaagggacagaggaatggataagacagatgaggttcctgctctcatggagcttacattttaatgggagaagaaagctcaacagataaataatataatgtcagatagtgataaacactatgaagaggccgggcatggtggctcacgcctgtaatcccagcactttgggaggtcaaggtgggcaaatcacctgaggtcaggagttcgagaccagcctagccaacatggtgaaaccccatctctactaaaaatacaagggcatggtggccagcacctgtagtcccagctactcgggaggctgaggcaggagaattgcttgaatccaggaggtggaagttgcagtgagccgagatcatgccactgtcctccagcctgggggacaagagcaaaactctgtctcaaaacaaaacaaaacaaaaacactatgaagaaaattacacaggtaatgagaaaggagaatgagtagatgataggaatgggtgatggtggatgatccttctttatattatgtggtcagagggccttccgttatcgggtgacatttgggcagagacctgggtgttggcaggaggccagccatgtgaccatctggggaaataggaataaatcttatcatttgcaaaatcttaggttactagcctattttccacgcttttttgtttccccctagttttagtcaagtctctcctatggtagcagtctctaagagcagagacgatcttatgtactgttacttcccattgcctacctagcatagggtctggtacatggttaacccgtagtgaatttttgttgaagatattcattggtgggcactagggatatggtggtaaactagactcatttagtctcctttttcttccatgaattttaaatgatgttttgcaagaagttcttttggattgaaaacttcaagatcagtgctaagcagtacggataattatacagtaatttactaatgtataatcccatataataatgctagtttcttacctgtactccttcagatatacctccgtagtctcgaagggggtaatatggagaattaggagttccttggtgaggagagttaggttttcacaaagttaggttttctctgagagaaaacaagcactaagatttttctataggcttaacacatttcatttaactgataactttgatttcgaggttctgccaaattattctagttataatagagatactgtaaaggactgaaaaattctgaaccctaaaaaaaaacaaaaaaaaaacgaaaaacagaagtcaagctagaagataagaaaggacaggcttgttagtttgttagtcattgattatcacatctgatagggttatagatattcaaatatgtcccaaataccagattagtttgttagtcattgattatcatatctgatagggttatagatattcaaatatgtcccaaatatcagattgtcacatctgatagggttatagatactcaaatatgtcccaaaagaacagctttcttcccctatatctttgggtagattttgtctataaccaagcattatttcgtagcactggagctgatttaaatgacccttgatgcaggaaggctgctcttctttctgtagtgcaaaagtattctgatcataatttcttattaaagtgatcagagatcccctcagacccaaaagtatactttataagtacttgttggtatcctgctgtgcattgtgaaagaattctggaggtgtgccaaacactgctcaacaataagcactttccattagttgagtagtgttgaatcttgtttccttacccactctttggccttaacaaattaagtcattttatagcttaaaaacatatttttattaacttttaatactctttttcatgtgttcaacattcttactttaaaatcatattgcttttctcctttaagaaacttaccaaaagcaagggtataaagtaactgaatgcaatgagtgtacctattattaggaattataaaggagaaacagttaatctgacttaaacttgtaggaaaaccatcactctgaatagaaaacaaagataaataggtaccgtatgcctctgtgtcctgtattttaaaaagaccttttgctcaacatcattctaaattcatgagtttgaggacaagagtccagaatttaatatgatgaaagtaaacataaagctaaaacttgggaaggttccctttaggtgctgtgtttactaaaaaggagacttgtaaattggtatctaacttgtttggcaaatttcttttagctctgaagggtttatatgctttcaaagaacctattggagaaatatgcactataattctaaacaagggtaacttgcccaaagtctcacagctaggaagttggactgccagatttgagttctagctcttccactccaggaatggggactcttaatcacttcattatataatcaatccattgtatcttggatcattgtttggtttctttttattggttttgttttattgctagcattatgttcttcccccacccctaattttgtgtgtttatgttttcagctatactttgggtcaaatagacttgcaaaaacctagccactttttgcagtgtcatacacttggggaagtaaggtctgtgttctctgtgagaggtttttttttttttttttgacagggtcttgttccattcccccagctggagtgcagtggagtgatcttggctcactgcaacctctgcctcatgggctcaagcgatcctcccatgtcagcctcccgagtagttgagaccacaggcatgcaccatcacacccagctattcttttgtatttttagtatagatggggtcttgccatgttgcccaggctggtcttgaactcttgagctcaagtgatctgccccccttggcctcccaaagtgctaggattactggtgtgagccactgcccggtcaaggtctgcattctaaaagaatttacaaatgacctttttggaaaac

SEQ ID NO: 138795 - DNA, 1051 bp, Homo sapiens
aaggcaaaactaacagtggaaaacagatcagtaattagcatgggtgggggtgagaggagggatatataaaggggtactaagagggaatttgaggcatgatgaaactctttggcatcttaattgtagtagtgtttacacagctctgcatttgtcaaaactcagagctgtacaacaaaaatgaattatactgtatataaattaaaatatatatttttaggctgactcaaaaagaattagaatgtccaacatccaaaccagtagaagggggaaacatgatcagtgaaacagggaaagaaggaaagaagcctagaaaaagtaaagttaatacaaagcacaaaaataacattggagagatagttccaatataactaatcaaaaggccgcatacaaatcagaaagacaacttacagtctgggagaagacattcatagtgcatataaccaacacaggattaatattcagaaaatataagtaggtttcataagtcaataagaaaaacaggtaagttcaaaaacgagcaaagaatatgaataggggattcacagaaaaggaaacccgaatgaccaatacattaataagatcaatctcactatggtcagaggaatgcagaataaaactgtaaggtattgtacttcacatgcatcagattaccaaaaatggaaaagccttacagcattaaatgatggcgtgatgaggaatgtagtctcatttatggtaggaatataaatgggcacaactactttgaaaagcaatagtaatatttagtaagatcaaagctgctgacatcttatgactgagtaattctaatcttaggatatacatctcacactatgtttgaaaagaaatctacaagaatgtttatttctgtattgtctgtagtgagtattaaaaaaatggaaacaagctatgagtgttcaacagaatggatgaattgtgttacatttataaaatacagtgttatataacagttgaatgaattagtactatatgtgtcaacacagataaatgtctaaaacaatggcgtgcaaaaaagcacgggaaaatacatcca

SEQ ID NO: 138796 - DNA, 1087 bp, Homo sapiens
ggtattgaagtcttcaaccattattgtagaactgtctatttctgccttcaattctaccagtttttacttcatatatagtgggactgttaggtatgtctgtttatgattattaataccttacccctatatcaatatatattattgttgtctcttgtaataatacacttttttacttaaaagtctattttatctgacattagtggagcaaccctagccctcttttggtttggtttgcttgcaatgtctttttccatcctttctctttcaacttgtttgtgtctagaacctaaagtgagtttcttgtcgacaatttatagttagatcttggttttaaatccattctgccaatctctgacttttgaaattggagagtttaatttttttacatctaaaataattactgatgaggaaggacttctgtcattttgctatttgttttctatgtatcatattttttttgttccttaatcctttattactgccgtctcttgtgtgtgtttctttttaaattcatgggttttttgttcactgctgtacttgatatatatgaagtaacaaatactgcatttttacttatatatttattcttggttgaattaattttataatcataaacatctagtagaaataacataagcttactcgactagtaaactcagaataaaagttgtgtgtctgcattatatttaatgctgatgctgacaactctgaaggcattttcttttcttttttttttttttaactaaaccaacagtattatttaccaaagattaccagtcaagtgaacttgaaaagcatttgggttagttcttctgttttctaagagaatacttaatttatgtaagtttctctttctgtccttttttttttttcttgagacagtcttgctctgtcgcccaggctggagtgcaatggcgctatcttggttcactgcaacctccgcctcctgggctcaagcaattctcctgcctcagcctcccgagtagctgtgatcataggcacatgccaccatacctggctaatatttgtattttttgtagagatggggtttcgccatgttgcccagcctggtcttgaactcctgagc

SEQ ID NO: 138797 - DNA, 1029 bp, Homo sapiens
ctagagtgctatgatacagtcatggctcactacagcctctacctcctgggctccagcaatcctcccacctcagcctcccaagtagctaggactacaggcacctgccaccacacctggctaattaacatttttttaatagagacaggggtctcactgtgttgcccagactggtctcgaactcctggcctcaattgatctgccgtcttggcctcccaaattgctgggactacaggagtgagccactgcccggccggaagttttctttcattcttagctttctgaatgtttttgtcattaaagggtgttgaactttgtcagatgctttttctgcatcaattgagatgatcatgtggtttatttccttcattctattcatgtggtgtaatacattgatttgttttcatatgtagaatcacccttgcattcttggcataaatcccatttggtcatgttgtctaatccttttggtatgttgttggatttgatttgctattattttttgaagatctttgcatctatattcataaggaatattgatctgtactattcttgcagtatctttatccagctttagtatcggagtaatgctagtgttatacaatgaactatcaagtatttggtcttctgttttttggaagactttcagaaggattggtgttcattcttctttaacagaattcaccagtgtgaaagtcagaggatgatgaaaaaaaaaagagaattcactagtgaagctgtctggtaccaggcttttcttttgggggatgttttcgattatttagtatcctacaggtctgttcagattttctatttctttttgcatcagttttaggtcatttgtatatttctaggaatttgtatttttttgtttgtttgtttttttcgtgtctttttttttttttttgagatggagtttcgctcttttcgcccaggctggagtgcagtggtgtgatctcggctcactgcaacctctgcctcctgggtttaagagattctccttcctcagcctccagagtagctgggactata

SEQ ID NO: 138798 - DNA, 1058 bp, Homo sapiens
gaagcccacttgatcatggtggataaactttttgatgtgctgctagattcggtttgccagtattttattgaggatttttgcatcgatgttcacatggccgggtacccctctgagacgaagcttctagaggaacgatcaggcagcaacatttgctgttcagcaatattcgctgttctgcagcctccgctgctgatacccaggcaaacagggtctggagtggacctccagcaaactccaacagacctgcagcttagggtcctgactgttagaaggaaaactaacaaacagaaaggacgtccatgccaaaaccccatctgtatgtcaccatcatcaaagaccaaaggtagataaaaccacagagatggggtttatttcttaattctattccattcttcttatatgtccgtcttacactggtgctacactgttttgattactatagctttttggtaaattttgaaatcagaaaatgtgaatgtttcacctttcctctttttcaagattgttttaactatttaggtgccttacatataattccatatggattttaggatcagctttttcatttctgcaaaaaaggccattgggattttgatagggattgcattgaatctatatatcactttggggagtattgtcatcttaacaatatgaagtcttctaatccatgaacaaaagatgtctttctgtttttaggtatttaaaatttttttttcagtaaagttttatatatgtcagtgtacttttcttgtctctccctaattatgttcctaaatattttgttctttttggtgctatcataaatgtaattgttttctaaatttacttttcatgctattcattgccagtgtatacaactgtatacagctgatttttgcatgtttatcttgtatctggcatttttgctggattcgtttgctagctcttatgaatttttgtggatttttaaggagtttctatttatagcatctttgccatctacagtttacttcttcctttccattttgggtgccttcaatttcttgcctaatttctctgagtggagatttcaacaatgt

SEQ ID NO: 138799 - DNA, 3153 bp, Homo sapiens
tcacctgaggtcaggagttcaagaccagcctggccaatatggtgacaccccatctctaccaaaaatacaaaaattagccaggcgtggtggcttgtgtctagtcccagctactcgggaagctgaggcagaagaatcacttgaacccaggaggtggaggttgcagtgagccaaagtggtgccactgcagtccagcctgggtgacagagcgagactccgtctcaaaaaaaaaaaaaaagaatcttcaacgtgtataaaacattttttaacctggtttattttcatgatacttttctctaaaaaagagatttaaataaataaaaattttaaaaaaggagattaaattcatgagccgaaactgttgtctttttaatggggtattaactaaatgggcttgagccaatgataatgaactttacattgaaaatttgccttctcttacagcctgctgatcttaagaagagaatagaatctttaattgaccgggactacatggaaagagataaagaaaatccaaaccagtacaactatattgcatagaatgttggccttgcagcatttggtgtcatatgcagtagccagtggataaactaacctgttgattcaatattatttgactccttttttactaccgatgaccaaatgaagcagtgtaattaatggaaatagttgagtggactttttctcagtggttaacatgcccattttaaagagtaatacttacctttaagaagaatgttgttgaactctttgcatgttatttagtatgatgtgcagaaaacacttaagaacgtacctggtcttcatgaattcctctttggaactgggaaagagatccctgtggctattaaaaaggggggagggttcttacacaccattaattatgaagcaaaaggtttatttgcttaaaatgtcatttaaagatacttaaactgcatgcaaactttatttactgtacagagttctggatgtatttatcaaatagaaaaaccacccttgacttggttgttcacccgttttgtgatttcccttgaaaagagaaatgaattgtcatagctattgatattttactaggtgatgttctgttacactgaaagggatgttttttaaaaaaaattatttggaaacaagttttcaagtagggggacagttgcttacataatatcttgtatattcacatcctaaaaattttcatttatgagtatgggatgtgtgtatatggcttagccccaagttaactgtgctgattaacaagtacttataaaaatagctaaagtagaaaattaatgatcagttgtactagaggaacatcatagaagagaaaaatccaactctttatattaaaaatgaatacaataagaaaattgcaaaagagaccaaaatgaacgtgttttgtaaattgttacaggagcaaaaactttgcaactagttttcaacatactttagactttaaatgttgtttggacagttttgtcttcaacttggaccaattgtagattgttacaggcttcctaggatttagcattcctattttctctaccaaagttttttttagaagcatcccaactcttctctttgttgataaataagcctttcctgtcatcttcattttaacttgctaaaaccctagatacaaaggtcctccctcatttttcccacagagcccctgtttgggaatttgagattctgtgtcatgctggttttcctttcagaattgcttgaaatcgagttctcttagccactggacacctagttttcaggagaatgtcccaagattgtttatatatacaaaatggcaaaagtactgtttttcgaattgataattcaagcaaaggcttctctttactgtcactgatttttttttgtttttattttgtttccttgtttctatttccttgaagctttgaagggaggagaagcagaaaattttgtttatgtttgttaaaaatcagaactacttaatgctttttgccacagcatatttccttgcctgttggagccgttaggaagattacctatgtcctaatcttcaacctgagaagatttttgactcttgtgtctactgttgattgtttgcttgagttctcaaagacctgtggccaggtattttaaaaagtcgtctatttctttctagttgcatcaacttgcacactggtgtctaactatatgtggtattcggaacttgtaattcttattgagcagccattgcctatattttctcagctcctcactgatttctttatatgagctcagctgacaagcaaatgcagctattttgtttaccctctcttcataccggaccatcaacaacagtgttctaactcatccctgatggtctgtgagatgtagactattacacaagattcaagttactcgtaagcaacttttagatagagttggtcctgttaggaggagactcttgatgtcaccttcagtatcttgaaagcgggtcccctccccgaggctcttaattctttgaaaacttgatgctgtttcagctgaaaaattagcaagactgttaaaaaaaaaaagttgaggggagctgtttaagaaactgaaaagtaattgcaaactacattggataattgtgactttcagttgttgttctgtatcagttgaatttttgtgctcttttccctgtgtacgtggtggttctatttttctccaataaaacttttatttaaaaaaagtttctagagaagatctttaaaattcaagtattgtaagaaagttataaaatcacaggacttaaaatcttcctaacaacttctaatgaactcacatttgttgattttgttatttttaaactttttaaaaattttgtaatggttttgtggtaatgctataagagtatgggggagggcatggttaacagggtgaggaaaattcccaggaatcctcaaggtggataattattcttaaacatgcggatacaagtataaacattgcttcattcaaatcctcagtgtcaaattgtttcataaagtcaatatgaaatgagtctagatttgagttcaggggagaagaaaagattactcttagttatggcatttgctctgccttttctgttaatagttttttgagttctgggccagatactctcagagtaagatgttcctcaaagtttttgaacccagttcctgagtctgcttgaat

SEQ ID NO: 138800 - DNA, 2186 bp, Homo sapiens
tgatttatatattacaaaataaaaattaattttcaaagaggttgactcttaactagtttgcttagccagttaataccatgccttgagtcagagatcagacagagtcaccttatagacaagctattgtcatagagaaatctggttaacaatccattgaaactgatacacacatttagaagatatatcaaagacagagtaaaaaaacaaaatggtaaattccacatcagctatctctacttctagaaaagcaattcaaagatgatgtttttctattaactaatattagcattacttcattggtatagggcaatataatcagaacagaaaggagttatgtttgtaggatttttctctgtcagcatctatatttataagaccccatttagataattcagtacctttaaagcaataacaatgtcatgtccctaaaatgcacaatttatgtaaatagtcaggttttgcttctggtataattcctaggtttaaaacttttttgttaggttgaagaacaagcaagcactacagaaagagtatttcaagacagacagtatcaaattgatgctgcaattgttcgaattatgaagatgagaaagacacttagccacaatctccttgtttcagaagtgtacaaccagttgaaatttccagtaaaggtaggtacttctgtgttttcctattgagcgtgttataaataaaagaaagtacattagattttcagacacaaatcttgcaaacataaagcgtcatgaccatttagagagagaaaagttttaatttcccatgttgatgcatatgatttccaaaaaaaaaaactttgttggcatatgtgggcagcagtgacaaaagggaaaaataacagaaaagcctggatacctgaaagtttaactgctaaatgagtgtttgaaattttcaagtttattcactatatttcttttgaacttcttggttggttatttacttcttttcctcttgaaataccatggtatttattgaaataccatggtatttgacagatttagttattgtggattgagttaaatctcctgtttagttagcttatataagagatcatctgttaaaaaccatacagataactagtcatgattaagcatctttttgaaaagtgtagtgatagttctggtaaactgaaattggtcattaaatggaaacgttccattgtgaatgaccaataataaagtcacttaatgtgatgttgtactggccttttttccaagttttaggaggtagatagccaaacccttggatgataaacattgatagagtttgaatagactgctagctattagggttcttatgagctttggactttcataaatcacttcaccatgctgatcttgtttcctcttttgtaaaactgagataataatagtacttaccttgtaggattattgtgaggtttaagtgagatcatgaatgtaaaaatcttagcactggacctggtacataataagcactcggtagctcttagttctaataaggtaagcattttcttttctccaaacctaatatcgcactcctcattaccaccctctcaccctcatgctctgcttaatagtcatttcacctcaagccagagagatcactgatgctggggaaattaggggatcgctgtagttaatattgtgctgatattctaggtctttcaccataattaagagaagtcatctgatttcccaaccttgggattactggataaaattttcactgctgtatcagactacttcccctcttttcccctcttgaacaagtggtcattttacttatcctgaaaaactttctattagcaaacaagattatattatatttacagactagatacataagatatatagtggaattttgtcatccaggagcttagaatgcaatcatgaagataaagctacaagctttcttgattacttttaaatcacaggatgcagaaatccaagtcacttagatgcactaaaccagaaatatgaagatctaaattatgaggtacttcatttatcaagccatttcatgtagtttttttttgagatggagtctcgctctgtcatccaggctggagtgcagtggcatgatcttggctcactgcagcgtctgcctcccgggttcaagcaattcttttgcctcagcctctcgagtagctgggaccacaggtgcgcacaatcacgcctggctaattt

SEQ ID NO: 138801 - DNA, 1173 bp, Homo sapiens
caccactgacaattggaaagaggacacagttatatggagatgatgaatcaaattttggacgtaactacagttgatagtaaaacagccaggcggaattgccctttaaacgtgcaactggagagaagtgaaatgtcattttggaatatttggtagttgcccacatggtatgataattgacgtctttaaaagaggactaggggccgggcgtggtggctcacatctgtaatcccagcactttgggaggccaaggcgggtggatcacttgagctcaggagtttgagaccagcctgggcaacatggtgaaaccccgcctctattttttttaaaaaagaagaggactaggaaaaaagccattggctagaacaaagaaaagttgttggtgacctttgggaaaaaatgaaatagttttaatagggggatggagtggaagctagattgaggtagaatgtcgtagttgttcatgctggtaacaaataactaaacctctgtttcttcttcagaggatggagagttaaggagaacactgcagtcattagcctgtggcaaagctagagttctggcgaaaaatccaaagggcaaagacattgaagatggtgacaagttcatttgtaatgatgatttcaaacataaacttttcaggataaagatcaatcaaatccagatgaaagaaacggtatttctttcactttctcttagtcctaacacactggaattatacatgttaataatcaaaatatataaagatttttatacctgtaatactgccaataccattaatattttttgtgtctatgtccagctaaatatgtttcctgatttgattttgggtgtttgggagagtggttgtacaggattgagatgatactcaacatagtttcatatcttactttgtttatttagtattcaatctttagaatttttccatgccattaaatagcttcgaaaaatggcagatggcagtgtaatatttttacatggctcttatagtttgttcaaccactgttcattttggggcaattaaattcatgacttattagtattataaataagattgcaagaaacctctttgaaactaaattttaatctctgatatatgataaatttgtggaagtagatttttttgggttaaagggtatgaacattttaggagtcttagtacataatgtcatattg

SEQ ID NO: 138802 - DNA, 2787 bp, Homo sapiens
cgcctcagccttccgaagtgctgggattacaggtgtaagtcaccaggcttggcatggatacttttaaaagtgtatgtcagtaagcgcaccaacaccaaataccaactgctttaatgttttacttttgtacttagaagtccagttaagcacatagctaataatgccaaatttctgggttcagggtcaatttccctggctcttcttccatcttcccaggttatacccctcactctacctagctattaagaattcttgcacatatttcacccataggtgggattgctaaatgatgggtccttgattaaatctatcctgactcctggtaaactgtctagtccaggactgaagcccataaaagggattaaggctagacagatagatattgagaatcctccatggagatgattatgaaggcccagggagtagatttctctcaaagaggaagaaaaaacagcagaggcagaactttagaaaaggctcacatttggcagatggtagaaagaggaacctgtgaaggaaaccaatgcagaagcaacagtgaaataaaggaagcagcatagtgcagaggcacaaaagctgctgcaggtgaatgtttcaaaagaggggatgattaaatgttcagagagagcaaaaggtataaatcctaataaatcccatttgatttggtggttgggagatcattgtttttcatcaaagtgattggtggacctactggatatagtcttaaaattttccagaaactatatcacatgaggtaagtataaaaatggtaaatgtggtattggatacagagcttaaataaagccttattttatttactttagatggtaaaacttcaggagattttcaagacattttacctaggcaaacatagtggcaggaaacttcagtggcagtcaaccctaggacactgtgtgttaaaagcagaatttaaagaggtaagtggatgttcccaaaacttttagttttcatctttatctttaatgtttaggtcatccttcttaactgaaagtttaggctattgttttttgttttcttcttttttttttttttttttttttttgagacagagtctcactctgtcaccagagtggagtgcagtggcgctatcttggctcaccgcaacctctgcctcctgggttcaggtgattctcctgcctcagcctcccgagtggctgggactacaggcgtgcgccaccatacccagctaattttttttgtatttttagtggagacggggtttcaccatgttggccaggatggtctctgtctcttgaccttgtgatccacgcgcctcggcctcctaaagtgctgggattacaggtgtgaaccaccgcatctggccagtttaagctgttgttttataattgtatcctagatatccgcatgatgacagtgatagtttgtcatagctttatgtatttttaagtaattttaggtgtgtggtctttccacgattgatttggcccttctgcaaaatgaaaagcagtgaactttccccctaccctttcctcacctgtggatgaaaactgtacactgccacttcctatttttatttatttgtttatttttagagatagggtcccactctgtcacccaggcaggagtacagtggcacaatcatagttcactgtaacctcaaactcatgggctcaagctatccccctgcctccgcttcctaaagtgctgggattacaggcatgagcaactacacttagtctaacactgccacttcttgacagaaatcttgttgctgggagctacgaatagagtgggagttaagggaaacagtgtgcaatatctaatctcaaaaaactttagcttttcatgactaatctgagccaaacaaatcaaaaatacatttgaaatagtgatttcttgctgcttgtgatgaatatctagaatgacacataaggctgattaattttcattactgtattctatttataaggcttaaaaaaaaactgttaaaaggtcagctaatccttccccctattttaggtagggtcacacctaaacctcacactgaaatactgtattaccacgtcaagtggctttgctggataatgctaatcatgtttctaaatccactaattgaaaaatgcttttcctataagagatgattaatttttcatgtgtttttaaaaaagtgatgactaaacacttttatttcttcaacagggtaaaaaggaactccaggtctctctttttcaaacactggtgctgctaatgtttaatgagggagaggagttcagtttagaagagatcaagcaggcaactggaataggtttgtagcaaacattaattgttcactatgtgcacaccactatgttaagaggtctgggggacatatttataggaataattccttgcctcagaactgttttgagttttttttttctttttttttaatgagacagggtctcactctgtcacccaggctggggtccagtggtacaatcatggctcaggctcaagtgattctcctgcctcagcctgccaagcagatgggactacaagtgcatgccaccgtgcctggctaatttttaaaatttttttttgtagagacagggtctcactatgttgcttagcctggtctcaaactcctgggctcaaggggtcttcctgcctcagcctccctaagtactgcaattacaggcatgagcccctgcagccagccagaactctttttttttcccctcaagacggaatcttgctctgtcacccaggctggagtgcagtggcgcgatctcggctcactgcaacctctgcctcctgtgttcaagc

SEQ ID NO: 138803 - DNA, 1530 bp, Homo sapiens
tcggaaagagtgcatctgtagatgctgaaaaatcaatgctgtccaaacttaaacatggtaggtttctcattctttctgttccttttctttgattcctgaaggagaatgttagctttttaccctttcaatcgatttcctcttttgtcactcatgtctatgtatatatgatgaaaacataaattgagcaagctcctgaggtttccaacttattgtacataatatccagagttgttttttttaagataaagcattgttcttggttttattatttgtataaaaatttcccatttattttatacctaaatagtagataaggttactacaggattaaagagtttgactctgaattaatggggcatacactttggggtaaggatttctttttattcttatgaaagttacagatcatacttcatactaaagttttgtatttcgtgtttcccacttttaaacctcttttgtttttaccactttaaaatattatacatgtacaaacatctttaatagaatgcggagctgctttcaccagcaaacttgaaggaatgtttaaagacatggaactttctaaagacatcatgattcagttcaaacaggtaaaagtgagttaaactcttaattcctcaaacttagttgtatttagttatctgcttgctatgatttgtactaaagaggataaatagaaacgtgtttgttgtaattcatggcaactgaggtgatattcacagtagaaaaaaaaattggtgaaatataagtatatttgacctactttaggatttatttttgacaaacacccagaataacacaaaaataaaaataaaatgtattgaactgaagtcagtacaagaagagctatagtgggaaaagggctttcctcagcatcttatcgtttggtaatttgcatgttcagagcttgcaatggggagagaggagaagtgataatgcagctgtataaaagcctttggggacattggggatagaaagctagatccacagttttgaagatgtaggtagaaagtagttttgaaatgtttaagatcataggtgataatgatggcaaattagattttcctcttttgggttttagtagtgacttctttaccccacagtgttgctaaggtgggaagtggaagtgaaagaattaagaaaaaatcagggtcagtaagattatggattctatagtagctacagaatagggcttatctgctttgcccttttcccctctttttccttccctactccaggtcactccctgcagacaggcagtggagcaagtgaaaaactggagacttgggctggctggggggtgaggaatgggggttgctgcaaggtgtttaagccacataggggtattcaaaggtggggactgcaggtggtattggggaaaagaatggagaagagatcctataacggcccagctgtatgtgagaaattatttaagttgataacgcctgtaatgaggtcatgtgatccttgtatgcctttgtatcaaaatgttaacctctgtacttgcctagtgcattttgtgtaggt

SEQ ID NO: 138804 - DNA, 2234 bp, Homo sapiens
aaagccagattgccattttaaggaagttgaaagctgacttctttaaaaataaggaaaagatcccagaggcttctaataataccctgttatgatatcatatgcccagtgatcattgcttactatttttgtgattatagatgagtggttaacagtgtggatatttagcactttatttttttgtcctcatttcactatcagctttattttgccaggtgcagtggtacatgcctgtaactccagctacttgggaggctgaggcaggaggatcctttcagcctaggagtttcagactagcctgggcaacatagcaagattccatcttaaaaatagctttatcttactttttaaagatctttaaatatatatgccacttaaaatatgatttggggattgttttcattgtagacaattcgattacagtaaaaagtggtaattttttgttttaggcatttggcagcactattgtaattaatcctgaaaaagataaaaccatggttcaagaattgctggattttaaagataaggttgaccatataattgatatctgctttctgaagaatgagaaatttatcaatgccatgaaagaagcatttgaaacgttcattaacaaaagaccaaataaaccagctgaacttataggtatgttttccagtcctttttccagttgtttaatgatgttctttgagtcataaaatctcaatctgaaatttttaccaggttgtagtattactaattcctgatttgtttgaggttgcttagctggtatatcaagtttgaagagtgtttctaaaaacctggatgtaagtactgaaagcccacatgtcaaacataatgtgctttctttcaaagacagtacgttggacactatttacctttattgataataagctaatctgttttcctagcctaatgatttaaaaatgaggcagggtgttatttcaagctacaaaaaagggcagcatgaaattacagttgtcagtgaaaaagaaaaaagtccagggcaaaaataaacctaataatctgggcccatttagcataaggatgtgatatacactacagtgcttctcaggtttttccacccaagtacccttagtgtcagaggaggaggtaacctgagaaggtctagggtcctctgccaaaaggatgaaattttgttgcaacctatctactatgtatccgtaaacatgtagcaaattttaccttctactctacgatgtatctggtttattttaatagaaaagtaatgtttaagattgcttactattcctataaaatggatactccagaagattcctcatgtcttttcgtggcttggattacatgatgccctcacagggctacatgagacctcccccacaggatatccgtatcctattttcataaacatcagtatagtgggaagtacatttgatctggagtcagaacacttgggtttgtgttcaggccctgatgttattagctctatggcactgaacaagtcagttgatcttcctgactttggagacttttaaaaatgcatataaatttctgaagtattgaaaaactcagtgtatcatactcctctttgggtatatatagtgcccagtacctcgtgtattccccggttattaaacaacaaacttttcccccattttagctaagtatgtagattcaaaacttcgtgcaggcaacaaagaagctacagatgaagaacttgagaaaatgttggataaaattatgatcatatttagatttatctatggtaagtatttactaatgttttaatatttttcttttaaaatagcactcaacagagaagctagcaagtatattcaaactggagggaatatttatttggaaattacagatttaaaattgtgtttaattcattggggggatacgtgaggaatgttacctgattgtcctatgctttggctcttctagtattaagtgccttgatttttgctacttggcttaatctcttaaatattggcaccaaagctaccagtccacaaaagcttttctgaagaaaagttaatgcaatcaagacagttacatgcaaaaaagttttacaataaagacttcgaaatgtctggcacaaaaatggatctctactgtttcttgcatttaacaaacttaaataaaatgtgtaaagtaaaataacttggaataatggtgtgctttattaaagcactttaaagcagttttgtcagtactttttattggaatattataaattttgcatttctttttac

SEQ ID NO: 138805 - DNA, 1072 bp, Homo sapiens
tatgtaagccagtttttataagtttgtttttgcctctaatctatcatgctaaatggcacaaaccattatggagttaaccatttttctttttctttttaatttttttaactttttgaattaaaatagagagggggagggggtcttactgttgtgcccaggctggtcttgacctcctggcttcaattgatcctcctgcctcagcctcccaaagtgctgggattacaggtgtgagccaccgtgcctggcctgtttttatttttatagcgactaaagtctctatatttagtttttacccagaaagatggttgggtttaattcaaaggaaatcttacattacaactcacatacagactagtcatagttcaaaccagtatcacaataatgattataactcaaattttattaaaatgtctgataatcttgttcacttttttgttcactatattttaatgccaaaatgttttaaaatacaggtttaaataacctccttgatgaaaaccgaattcaagatttgtctcttctgtatcagctcttcagtagagttcgaggtggagttcaggttcttttgcagcagtggatcgaatatatcaaggtattaacaatttacctgtgatttttctctcttatggcttatctacacatcaagagtgcatattggcaagcatttcttgtttgatccaatttttttttttttgagacagagttttgctctcgtcacccaggctggagtgcggtggcacgatcttagctcgctgcaacctctgcctcccaggttcaagtgattctcctgcctcagcctcccaagtagctaggattacaggcatgcaccaccatgcctggctaattttgtatttttagtagagacggggtttcaccatgttggtcaggctggccttgaactcctgaactcaaatgatccacccgccttggcctcccaaagtgctgggattacaggcgtgagccaccacacccggacttgatccagttcttttaagggaattttaaatttgtttaaaaagtaatgggaattttgagaacagtcaacctgagaatggtagctgtgtggcatatc

SEQ ID NO: 138806 - DNA, 4489 bp, Homo sapiens
actcaaatgttaatctcttttggcaacaccctcacagacacacccaggatcaatactttgtatccttcaatccaatcaagttgacactcagtagtaaccatcacagttgcctaggctgttctagcctggcatcaagcaatcctctcaccttggccccccaaaatgttgggattacaggcatgaaccactgtacccagcccaagtaggattttctttgagcagcatgttggcactcaaaaagtttcagatttttgagctttttggatttcagatttttagattaaagatgctaaacctgtaatttgttcttttttgatacagtgcattggttatgagaaagtttgccacccacattgatatattttgttgttttaccttgtgtcttaagtggatgaataaccctttttaataagctgatgtggtagaaatatcaaattaataagaatctgatgtaaatagttgagaaatccttcatcctctccttaagaaagtattttaaccttgcaggctgtagaaaatctctgttcttacaagatttctgcaaacttgtacaaacagctgagacagatctgcgaagatcacatcaaagcacagattcatcaattcagagaatatcctttttaaaacaaaaaatcgtgaatagttttgtcttcctctctgtccctacccctcactgtttaacccagcttgaagtagaatgcctgtattttgtaggtttgtcattttttgtgccttgtgtttctcgagaaagaaacacattttgacttttcagccttaattcgtgtccaggactacgtgtggtattcatgtaaataagatgtccttatgtctttatcctttttgccctatcagatttccacttgaggaaaaataatctcctaagggaaatagtaaactgaaaacacgatgttcagttatgtctaagacttgtttttaaaggtgttttttagtataaactatgttttttttttcttttacaaattaggaaatagcactttggtgcataatcaagtgccatttagtttcacttagtgtgcaaggtattcatgtttaagactaatatgctctctgtcacatggcacatatgacttgtaccaaacgctttaaaatatccttaacatatgtttcagggattcattggatagcgttctttttttaaagaagattgatagatgctggcaaaaccattgcagacaaatggtaagctggaaaaagtattgtatttcggctaaacattgtattaatagttaaaaacatttcttcaaatacaggaatgttagtttttaaaacttagcaatagggagattgcttcaatatctattccttttctttttttttctttttttaaaaatttatttattttttattttcccgtaagttattggggtacaggtgacatttggttacatgagtaagttccttagtggtgatttgtaagattttggtgcacccttcaccagagcagtatacattgcaccattgtagtcttttatccctcgcccccctcccactcttcctcccaagttccttttctgaattggaaactagttttggttgagttttctattttaaaaccacaagttacaggtaaacctgcatttcagaatgtcttgcaccttaggttcatttttatttttgtcacacttaccaaaaatgtatttatctcattcattaaaaagctacatttcgtctgtcactcttatttttttttctctcttgatgattatcctgtccactatttgattacctgtgaaggtgcctgatggtcctgtgttttagtttattcagataacaaccttttccatttttcttaatctggtttataccttatattctacagattaaaatcttaaaatccatcacccctccccacccccaccccctgccaataaaaaccctcacatgtgcaatgtaaggcagcttcattccctagcactgtggcgcaggaagaattatatgagcgtccccttgatttttcagttacttctcaagcagtaaatcagagggccattttaagtgtcttttttctagaaaacacaaaaaggattgactgttgagtaataaaaactatatgggcatattctcagatagatgtgtttatctgcatgtttgatcttagtaatgtaatatatatacagacaaactcttcagttttattcttattgaaagcaaatatttcagcttcacaacatacaaaacttgtttgatttctttttttttcattggcagatcatgatcaggagcatttttttgtttctggatagaacttacgttcttcagaattcaatgctaccctccatttggtaaggatgccagaaaaatatgaaaagattgttccaaatcatactcaaatcttaattacactaatgaaagtgtataagctatactgtgaatattctaaaaattcacatttggttctagactttcctttgtagcagttttatcttcctaataatatgttgcctatgctaatattgaagatagctaacattccctgggcatatattaatttatgaagaagttttttgttagccgaggggactaaagtttgctctggaatgtctatgattgtgattcattttgctgctgaccatcaagagttcactcatttaacattatgcaaaagtccatgtatacacgaaaatagaatagtatcatgaactcttccccctcccatgtacctatcatctgcctacagcaatgatcagaattcactgattcttcagtattgaaaccagttgataaataaccaaataagctttcaataccagtacagtgaaaactgttttatgtcttagaactaattttgtctgttgatttgagcaaagaagaaatccacaaaaagaaataatacaacaaaacttagttatggaggaaaataggaatttagcttcaattctcagtaaaggcaaaatgagtttcctgtgttctttaatctaataatgttattcaaaattaaatgtgtggattttattttttgacaattgctgcttcaaagccctggagccctaattagcatgggaacatgtggtaagaagttaagcaaacctcttcagaagtggtattgtcaattaatttaggttatatgtgttttttattttagggacatgggactggagttatttagggctcatattataagtgatcagaaagtgcagaataagacaattgatggcattcttctcttgattgagagggaaaggaatggtgaagcaattgatagaagtttacttcgaagccttttaagcatgctgtctgatttgcaagtaagttaactactacacctactatacagagctgattgctatcctagttttttttccccccacatcagacaggtaatgtgctgatgtcataacaaggtttgaaggaagcacatctcatatatgagcataaaaacccaatcatcatgcttctcaactacaaaaggatcctagcttgatgtttaaaaaccaaattcataatgctgtttacatagacatagaggacatttagtaaatatttgctaaataaatgatctccttcattttgttccccctccagatttatcaagattcttttgaacaacgatttttggaagaaactaaccggctctatgcagctgaaggccaaaaattaatgcaagaaagagaggtatttaaaaatcatgactaataaattctcactgtctctcacaatagaccttactttgtagaatataagcttccctttgcatttatcttcccaacattgtgatgctcttctctcacttaggtgctcctttcttttctctcttcttaaaggccagaattctggatcataaactctacctataaatttttacatatgattctaccctgtcacatttgacagggccacttccaggatcttttggacttgacattttctgaatgatttatggggaggaaaacaataatgtaaaaaactatctttgtaggttcctgaatatctacatcatgttaacaaacgtctagaagaagaagcagacagacttattacttacttagatcagaccacccagtaagtaccacatgctgaatttaatagtcttaaactgtcgttaaatcacttgcagcactttagccatcctaaacatgttagtaactgttttcaggtgtgatttgaagtgttaacagttgttttcataatacaaacttcaagttattcttttccctagttaattagttttcatccaaggattcgattattaggggtgtgtgtgtgtgtgtgtgtgtgtgtgtgtgtgtgtgtttagaaggtaatttagaaataatactagaggctgatgtgacctttaaactcttcaggccaattaaaattcagtggattcccctatttctgtgctttcctaagtattaatattgccagtcgaggggcctctgtatgtagtacttctttaccttcctaataaaagtagcaaaacttggaaaaagccgactacagcaaggtcttggagatatttatttcgttatgtaaaccaaattctaaa

SEQ ID NO: 138807 - DNA, 1040 bp, Homo sapiens
taaattcccttaagcatttgtggcctagccccaggtcacgtgaaaagtgggcaggccagcagggtctcagccttcttattcctccatagctgctcaatctaattggcctgctgtttcctgatgaggtgtggtgacttgtctcgtggtgtaagaggtttcctttaagctctgctctgctctgctcttctcttcttttttcttctcttctcgagacagagtctcacactgttgcctgggctggaatgcaatggcacattctcggctcactgcaacctccaccgcccgggttgatgagattctcctgcctcagcctcccgagtagctggtgcacaccaccacacccggctaatttttgtatttttagtagagacagggtttcactatgttggtcagagtggtctcgaactccagacctcatgatctgcccgcctcggcctcccaaagtgctgggattacaggcgtgagccaccgcgctctgccaagctttcttttcatttgctgatttatttactggacctgcatattgggaatgtgacttctaactacatatttttaaaattccactccaacccacagaacttggatgcccccctagagttcattttaatggaatttttttcttctgttgtggtgagaaaggaattctggtgttacatttaagtcattaccacttggaattatagattatatcagagttttcccaaagagttttagcatgcctgttgttttaaatttgaaagtcttttatatatgcataacaggaaacttacggaaatctgaaggtcatccttctggaatctgagtataaaagaagaccaattcagttattaaagtgaagtaaaaatgcagttctttcttttgtaattggcgttaattcagttgtacaaattttatttattttttattttattcctttttgagatggagtctctctctgttgcccaggctggagtgcactggtgtgatctcggctcactgcaccctccacctcctgggttcaagcaattctcctgcctcagcctcctgagtagctgggatta

SEQ ID NO: 138808 - DNA, 1769 bp, Homo sapiens
cctggattaggagtcagaagatgggtttgggatctagttttgactgctgttaccctcataatcttgggccaggtactaaagccctctcagttttttttcctgtttttttaagagataggggtcttgctatgttgcccaggctggtcttgaactccagggctacagcagtcttgtcacctcaacctcccaaggtgctgagattacaggcatgagctaccaaacccagccgtcactctcaatttaaatttcctcctctctaaagtagaggaaataatagtttgccctacctgtctcacaaggttgctgataagaatcaaataagatatttgtggaaaacgcctccaggcactataatcttacaaatataagatggtatcacgagtcaaacttttttacaagccacattatagcttcttcacttgtagtatgacaattgagatcaccagtttctgttgctgtgaaaattagtacacgcaaaatactcaaatcagtgcacaacacatagtaataatgccgtgtaacattataagcattataatgctatgcaaatgtcggctagtagttgtagtactaagctattacttaagaataagcccatttcatatggctcttttggcgtattatatatgcgtctcttaaaatgtacaacaataaaagccaaaatatgaaactgacttggaaaggccttaagagagcatgtggtccaatattttttctttgtggtgtccatgacagcctgcaaaggggattcatctcgtattatctcatataagcattatggaaaccctttctggggtacgtagggtagtagttactatccccacttttttttttttttttttttgagatggagtcttgctatgtcactcaggctggagtgcagtggcgtgatctcggctcactgcaacctccacctcccgggctcaagtgatcctcttgcctcagcttcccaagtaggtggaattacaggcgcctgccaccacgccctgctagtttttgtatttttagtagagacagggtttcaccatgttggccgggctgatctcgaactcctgacctcaagtgatccacccgcctccacctcccaaggtgctgggattacaggtgtgagccaccgcgcctggcctatccccactttattgatgaggagactgagtctcagagaagttgaataacctgcccagagtcacatattggcagagcaggggcaactcaaactgagatgctggatttctagttcattgcacttttactcctgtaccacctcactaatataccctggtactttgaataccactgtagtgcagtgtttgaaacaattaaattgttttactttagggaaaaagctctttataattttagtagtatttttatctgtgcatgcataagtggtgtttatttggatagtatatggtgtttatttggatatgctggtatacagcatatttaatttcaataatattttatatattccatatttgtaacaaatgtttattgtggttattaattaaccctatttactttaccttgaatatttttccagagcttttgatttgaaaatacttttcctgatacattgattctgttaaatctttttctttcaagagcatagagcttgcatctcttgtttttgttttcttgtacttcgtaagttttacctgctgttgttcagttgcatttctttagcctagtcacaagtcttataacttcactgtttgcatttttcataataccttactgcttttgctataatgaattcaaaagcattg

SEQ ID NO: 138809 - DNA, 2778 bp, Homo sapiens
atgcataatcaatgaggtggaggggaggtccttttttggtggagggttcattttccgggggtggttaggatccttgtgctgaagcatacaccgggtgtttctgtgcagtattttgaggtctttttcaacctattgtatttaatctgttattccttataacactgacaatcggtatgattgatccggattttgcaggtgagaaatttgtattctaaagaggtttatttatttcaggtgcatagcgagccttggcattgctgggatttttatttttatgcttcagtaggccacattatccaatgcctagaaatgcaggtagcaatagtgatctttttatgctcaaataagatttataattagatttatactgtattcatgaaactcatttggaaggaatatttgaagaaaaatttatgttctctgcatttctttccaaaggtagggtttgaaagtgaaaaacattgtgtatacacagaagtagtaactctgtgtaccactagtctaaagataggaacaattactacatctattttttccatcactaaaatggattttaaagtatcgacctgcagcttttaggaaaatttgttcagaccgtgtttgagatatgtgaggagagtattatgaatacattgaggcaaatataaaatcagcaatttttaaaaatgtatttgagctgaattaatttttatttgttgaatgtgtttctgtttttctgacttactttttcaacacccgtaactgccaggtaatcagtgctacagtgtttattaaatagagaagtaaatgaatgaacttaagtaatatttatgagataagtgctttgtggctgaatattagtattgagaagattaggttctctatgcttgtgtttttaacattgtgtggaaatcaggagtatgctctattttgtctcaagcagagggctatggtgttgtctatttttaaccctttcttttttatatcactaccttcccatacccaggctctcagtttctgatttaatagtagagctttctgaagtcaatatgaattgtaattgagtaacgttttcattatttcacttaaaaatatatggattttgtagctaaagatttttaaatgagttatgatcctggttgcattttcaaattggtttcagagatttttttctctccctcctaaaataaaagcatattattaaggcatttggatattctaattaaaacttttttccccacactcattgctagtcagtgaagtttaaagcctagagtaagatgtttctttctattctgaaaatgcaacatggtttctggagtcatttctttcagtctttaaaaatttcactctgctcgtaaatgtagtttaaaacctgagttaagatgtttccatttctatagatgctgcataaatgtgggggtcaaacagacctgaattagaatcccagctttgccattgactagctatgatgaccttgggcaagcttactaaatgagttccagcctcagtttcctcggttgtaaaatagattcctcagggtattgttgggaagattaagaggcttataaagtaccttgcacatagacagtactttaaatctcaggttaaaaattcatgtcgacttaggttttacacatgatgaaataagatcaggattgttattttttatggtcattcttgaatttttatttttttgaagcaatacaatcaataggagaaaaacctcaccttcaattttaataggtgagtcaaaatgacttaaacagtattatggcatttcaaattttattctttatattaagcttaaatacagtggttactttaatgattaggtgtaatagttataaagatcacaatttaccctaaaattagtaatgctattatattttatgaatctttggttactgtatctgacatggtattctgatgccaaccttttacatatcatctagataagcctaaattaccagaaaactacacagatgaaacctggcaaaaactgaaagaagcagtggaagctattcagaatagtacttcaattaagtacaatttagaagaactctaccaggtatgtattaatatgcataaccagatttgattaacataaattgaggtgggatgtatatggattttgctttctgaaataggttcttaagtagacttttggttcccttctaattttagtttctccattaattgatgaactctataattagaccacgtattctcacataaaccatgggtacagtcataccagtataagttgtgcttatatttgaccctcctgataagaaattacagttacgtgtaccttggtgtaatagaagttctacctataatgtaatcctatagcatgaatcccaaagatgatttctggtgacatgtcattctattgtgataattgtttcttagttgtgttacctacccataggaaaggcctcaagacatgcagatattattcatatcctttattctacctccttcttaatagtagactttgccatttctttttcttgctctttacatttttctaatacctgggctacaagacgcaccttagcccagaaatgagtagcagtttgtagtccagcagcttagtctgaggttcagattctttacttagcaaatgggtccttacacttaaatataattttaagggcagttcctaagggcaatcccttgctaccaagaaatttttccctactgtgtatttgacacacaaccaattcaagaagttactttcattagagtgtcagggatttggtgttaaaagatacttcaggccgggcacggtgg

SEQ ID NO: 138810 - DNA, 2166 bp, Homo sapiens
tcccaggtactcaagaaggctgacgcacaagaatcgcttgaacccgggaggcagaggttgcagtgagccaagattacaccactgcagtccagcctgggcgacacagcaagattctgtcttcaaaacaaaacaaaatgaaaaaaactatgtggtatattcaaaacagataggagtgcttccatctgtctcctttcaggcccccatctcccttctcagcggttctaagttccattagagccttgctttcagcaggctgtcatcaaatagcaatgatattgtctaataatgccaaaggttgatttgcattttaatcagggacttttcaagacacaaaaacaagtgggcctgtttaaacaaagttagaaagttgatttatttgcagggttctgattcacctatcacaaggtataccatacaagctgcttttactccactcacaatcctgtcacccctggtttgtaaaagctctgcttgctggattgtctccctgctatctatgatcgcctacagagtagactccaaattcttggcttggtgtgccaggcacttttgagcctcatcttccttactcccagccagacatcctacttcccagcctcactgcactttccatgtttccataaacaggcctggccctttcactccttgctttgcccttgtttccgttccccagaatgcctttcatcctgttccctcttctctttttggcaactcccactttgagacacagcataaacataatctctgtagaactcttcctattccagatttctcccaaatttcttgttttgcctcttctgacagcactttgtatatatgtcatattattgttatggaaattagttttgaaactatcttcccctactggcttctcaagggcagagaccttgcatagtcttaccatacatgctaactgaatgcttttgcagttagaatgatcaacaggttggcaaatttagtttttgatattgtgttacctccctctgagaatgccccaaggttaagtaaaaactcccaacagggaatttacaaggtttattgttgctaatttaaccaaacttaaagattttttaaatcaataatcaattgtaaagcatggggtcatgaaacacattagtagaaaacactgacttttgccgatatggttctaaaatgtctcctttgggacagcgtgtaaactgagatttggcaaaagaaggaagtgggtcttagctttgttgggtctataaattactgagttaaggactgatagagtgggggttaggacgatcctgggcatagtgctgggtgggtgaggggttagttacctttccatttcttcgccttagaatacacacttaatttggccagccagcttagaaaatgctcctggtagtaagataaaaggatttacagctacatgaaagagaaaggcatcaaaattcaggccttattcagccttgggtctgtggtgccttgagataaaagagaaacaatttataccggcaccgaattaaaaagtccttttcttcctatcttagctcgttttcttctcctttcctatcttaacatagggacattcctctccagcagcgggcataatggcatgattatgttttcctctatttagggttactcccctagccttgcaaccactccttattctttcatctctttcaaagtttctattctcccggacccttacgttttattccgtccctccctctctcctcctcttcctcctcctccgttttcccagctagctcactccgcccctcgccgtcactaccttccctcccccgaggctccttcccgctcctcccgccaccccccccaccccctcgccttcagaaagctccaatcaggagctccgaaggtgtctcgaaggcccgccccctcctcctatccacttttcttccccccaatttctccctccccccttcccccccccactcaagtcctgcggacctgggggcttcgggatctgggcgctatgaaaagtgtctgcccagtcacttccggtaagggcgctgcggcgcgaagcttcccgcgggaccgttaaggagggagtgggagttcccggtgggccagggaaggaaggcgctgccaggaaaggggatcgcgaaggggagcgggagcaggagcgaactagcgcgagcgtctggggcactttagccgcccctttcc

SEQ ID NO: 138811 - DNA, 1669 bp, Homo sapiens
ggcgcctgtagtcccagctacttgggaggctgaggcaggagaatggcatgaacccgggaggcggagcttgcagtgagctgagatggcgccgctgcactccagcctgggtgacagagcgagacactgtctcagacaaaaaaaaaaaaaaaaagtaaatggactgccctttacctagcagtttttttttttttttttttttttttgcactctgtcacctaggctggagtgcagtggtgcaatctcggctcactgcaacctctgcctcccgggttcaaacaattctcctacttcagcctcccaagtagctgggaccacagatgtgcaccaccaggcctggctaatttttgtatttttagtagagacagggtatcgccatgttgcccaggctggtctcaaactcctggccaagtgatccacccactctggcctcccaaagtgctgggattacaggtgtgaaccactgtgcccagccgttttttctgttttgttttgttttggtttttgctttttgttgttgtttgtgtttttttaatgcattctcagaaacatcttcagattctcctgggcaagcagtctctcccattcctaaggaaaatcccacccattggataggaaggcttccaggagtgtctgtctagtggcaagccactggtatgagatatctggagaggacctaaagcaccccagatggctataactgtatggcgtcctacattacacatcttgattccccaagcaccctggggaatccctgtgatcaaaaaggggaaatgggttacactctgcctttttagggagatgtccacagaaataaaggaattgacattgtaaaagctagctccctgtctttgtttgtatttcttcctttacacatatacttacctttataaacagcttggttaaaggtggccaataataactacacttcatgtggcaacattgtaaagtttaattaatgtttctaaggtatgagttgaactcacaagatgaaagatcctaaatatggaatatgtgttaagtgcccagtctggtttagtctgataatggctataattgtatggtgtcctacattacacatcttgattagtgtggctcccgtgagttcaaccttgaaaatgtattttaatgttgagaatgtgtttaacgttgattggcaaacatttgggtgtacagaatatacgcttatgttcttcaactagcctcaattagttggttcttgatgtaaaagatattttacaaaccaacttggaaggtttttgtttttttttgagacagactctttctctgttgcccaggcaggagtgtagtggcacaatctcggctcactgcaacctccacctcctgagttcaagcgattcttctgccttatcctcccgagtagttgggattacaggcacctgccaacgtgcccagataatttttgtgtttttagtagagatagggtttcaccatgttggccaggctggtcttgaacccctgacctcaggtgatcggcccgcctcagcctcccaaagttttgggattacaagcctgagccacctagccttgttttttgtttgtttgtttgttttttgtaacaaggtctcactctgtcacccaggctggagtgcagcagtgtgagcttggctcactgcaacctctgcctcaggttcaagggattcttttgcct

SEQ ID NO: 138812 - DNA, 1335 bp, Homo sapiens
tgaatttacctaaattccccttccctaaattttcctcccatacttcccctagagcaatctcctatcccagatcttacattaattattccccccaccccaccccacccccttttttttgttatctccctgtgttgctcaggctagtctcgaactcctgggctcaagcgatcctcctgcctcagcctcccaagtagctgggactacaggtgcataccatatcacccagctattttccttctatactttaatacttttatcatattatatatctgcaagtttttcttatttttgagctttatttaaaaagttatcaaattgtaggtattatttggtgatttgtgtttttcacataacattgtttgagacttatgcacatggctgtaatttattcattgttcaatgctgtatagtatttcattatgtgactataccacaatttatttagccattttcttatcaaagaatattctcttgccatcctttgaagtctgcatgcagaataggaatagaaaatccttagcatgttctaaatcactttctcctttgtgccatgtctctgtttttaacaattagtatattcaaatgcaaggactggcaatttttttttctgttaaggaactagtaggaactattttagactctgtgggccatacggtctctgtcaaaactctaaactctgctgttttagcataaaagcagccacagaaaatacataggcaaataaatattgcaatgttccaataaaactttatttacaaaaacaggtaaaggacagggtttggtccatgggctgtggtttccaaaccctgctgtagtttatctgaatttttgtagtgttgcccagtattgtggttcttattatcaagtctgcccttgtcttactttgcacgtgtcaaaccctattctcccgctttgtgattctcacctcctatatctaagagtgagcctgacttgtaaatccaattcctgaaccagtgtggctcaaggcaagaagtgttatctgtagccacagctccaacagcaagtagggtatttgagtaagatttggtgctaagaggcctaagattgctgtaccagacttgagattgggatgctgccttcatttccttcattagctcttcagagtttctggttaggactgaagttacactctaataactagtctccttgcaatgtcctgaatgtgccttactctctcttcctttaggatttaaatgtgcttcctatcttccttctttatgccccctgctccctttcactccctttgcctggctaattcccactcactctcggggatttaaattggatttctttctctggaagctattcttaatt

SEQ ID NO: 138813 - DNA, 1802 bp, Homo sapiens
gcgagagctaagatcctctttctctctcccccgcccctgccatcctgactccctaaggttttctatagtactatgctctcactcccaacttgaacacttctttaagctttccatccgtagtccttaattgggtttcagtccctccactcccattgttttttctccttacccctctttctcttttgccccctcccccaattctgtctccattcctagggttctaccaatcacatccgtgcactgtgatttagaggcatattctctgtagctgagaggggagccctgcgctcactgccatatgtttattagttatgaactgaataaaggaaggcttgacttcctgggtcatgggagtgaaggagtctgggtgacaggaagcaagcggcctgtcatgcctattgcctagctgccagattaaccttgccttgaaaataacgattgccccataggctattcagtgtaaggaagacaaaaattccttgggaacctactagtgggtttgccttccagatttggtagacgcaaaaagcaaagggggaacatgggcaaaggaaggtgggttttgtgcatgaaattttgagcaaaaacgaatagggatcttagaaatcattattatcatcacttaaaaaaaatctcagcagattacatagcctagcaggggccgattttctatgttatgcttgggttggtcttttgtatctcaagaattgagggttttgttttctgatctcaggttttattattggtgggagcctgtgtttcttcctgggtagaattgaataagattttccaggaaaggcatttgtgtagctaattacagattatggtgcaaagtatgtctcatattcctccccctaaccccagctaattgctgtatacttgacagtttatttcaatattgtattaagacattggttttgtgctggacagagtaaaagggagatggtatttttttttaaaagaacaatttatttcataattaagtatctaaatacttggttgggaataaatgactaattagaacagtacctttaggtattctgatacctctacttagaaatgccttttcttttcttgcaaaaattacttggcagatttgatgaaaaagaaaatgtgtccaactgcatccagttgaaaacttcagttattaagggtattaagaatcaattgatagagcaatttccaggtattgaaccatggcttaatcaaatcatgcctaagaaagatcctgtcaaaatagtccgatggtaagtctttgtttttgtctgtgtaaagctcggtatagctgaatatttaatgattagattgcactcatactaaatggaattattttcagattaactattgatagattaataatggggtagacacagaataactctaaaactccaatatttgtattttcaaagattttctatgtccctgaaaaaatgtggctttgtgtattgattgttctagtaaagagttaaatgttttagttcagagttggatttaatttatttcagtttgttgtttagagaattgttttattgaattacctaacaatggaattaataaaatgtgaaataaaattggttgtagcaggtaatatttttctttttttctctactggacttgcatgataggaaaaacaatgtaaacaatattttttggccaggatttttactgactttttaagaaagtttatcactgtatatgcgtgttttatattgtgaatttttgaaagaaaatatctaacttggtactttgtgacatttgtcttacagccatgaacatatagaaatccttacagtaaatggaga

SEQ ID NO: 138814 - DNA, 1053 bp, Homo sapiens
cctttgcctttttctgttgagtcattagtcttattattaatatattgtatatcttttcttacagatccttttatcctgccacaccagcaggttgataaaggagccatcaaatttgtactcagtggagcaaatatcatgtgtccaggcttaacttctcctggagctaagctttaccctgctgcagtagataccattgttgtatccttcccaggctaaaactgctgaaaaatgtattcattgtgctcttatcattactgcgaaaggtgtaccatccaagagaacattagatgtacttttttgaaggttactgttactcttatctcatgcctttctggttacatttgaagttgtacaaagtaattttatttgttgctactaaattatctcatcttaggtcgtttcttagaagttaaatgagaacaagttacagaagagtctcagctgcatttcagcccagtcagggcctactgttatcagacttaggacacaatagggaattcttgattactaggggaaaggatatagatgatataattggatcagctttttggatatcaacttgccactgtaatgttcattttgacttactgacatacgttggagtgaaagctctcaaaagggaaaagaatttaggcaccaggtataggtatctcttaccaagcaacaattttgtgttaggagtgaatagtgggaaatattggcaacctccaacttttattttgaaaattaattatttgaaaagttgagtttgggggcctcagagcacgttttctcaaagagaaatgtcagagtcccagatggtccttaaagatcgattcaactcatgacatagctgaataattctgcattatttccatttctaccatgctgtttcagctattttctggattaaatagatttttgtgactattctggacaggagaacatcttctcctttatcatagctaaagtagccatttgcctcgggtatagaaaaggaatggtacttggtgggaatagggaaactacttttagagtgtgtttatcttattttagtttttgagatggagtctc

SEQ ID NO: 138815 - DNA, 1028 bp, Homo sapiens
cagctactcgggaggctgaggcaggagaattgcttgaacccgggaggcagaggttgcaatgagccaagactgcgccattgcactccagcctgggcaacagagtgagactctgtctcaagaacaaacaaaaatccccactagtcagtgatcagaataattaatcagaacaattaatatttattgatttcacagtttttagtatttatgtgcaagaaattttactccttttttgtgtgacttattctggttttgttagcatggggttatagtattaacatttgacttgaaagaaaaggggttattagatttattcatttagcatttactgagtatttacagtgtacccacagactctgctaggtctctgctctcaaggagttaatggtctaggagaagacacaagaggggttccaagtggcttaactagtaacatgatcattatttgacacccttcccttgatggggaggccccaaggcattttgataaatagttttcttagctgtgttctttcaggctatcatggcagaaggaaaacagcatgctctatgtgttggagtcatgaagatgtctgcagaagacatgtaagtcttactttaggcccccttaacttttgatatatgggtaaccaacccaggaagcatcagaattacaggtgaaatttgctatcatgcataccacattacacaaatatccaagcacagaagcttcatttctgatatttcctaacacttaggaagccaatgaaacctattttgtcttcaggattgtagtctttcttaagcactgaaaagaacccatgtgccaacacagctgttttatatgtgtgtacgtggtactttaggaatcttatttagtatcatttaaattgggggaggagggaagatgttttactgctagcttcattttatttatttttatttttatttttttaagtttttttgagatggagtctcactctgttgcccaggctggagtgcagtggcgcgatcccgcctcactgcaacctctgcctcccaggttcaagcga

SEQ ID NO: 138816 - DNA, 1034 bp, Homo sapiens
gcaagtattaattatactaatgagttcagatgtttttatttatttttcctcccaatgacctattcttaatgaacatggtattattaagagacattccagtgaatcatctcctgtatttttttacatgcataaattatattccctaaggccagactcttaaacagacagatgaacctaatagtctcaacaatgatttaaaaactggccctcaattttcttcattcattcctgatctcgtggagttgtggtcctttacttggttttaacacagtattcaacaaattgttgttatagttgataacatctactcattcttttacctgccttaaaaagtgtaataaaagtattcatacaaagtataaaatacatacaagtataaaaatgtataatacatttaatttacatgcatctctacaatgacaagtatgatttctttagaaactgatgcatacattttcactgtttttctttcattatatatcagttttaatgcatactacttagaaattagaatcattttgagtttcttgaagagccttgataattatagtctcaaaattaaggaacctagacaaacaaagttaaaatatttatgacattttgcttgggcatacattcatatttccattaatatataattgctacattattaataagtgacatatttattataatgaaacacctccacgaatttagtgaattgtaattcttatctcttcctctgaagtattatacttagaaatacgtatcttcagttactgatttgggtacgacagggaacctggctggatatcattattatttgatatatgccatataaccttctgtttggggaatataaaatccctcaaattggaaatgttcatgactacccatgggataaatccagctgtttttgtttggggtccagagcataaaaacagaaaaggaaaaatgcagcttcccaacagaccactaccaaaccaccataacagacagtctgctagaagagaactgatcaggccattatgtcaccggacaacaggacaatcatc

SEQ ID NO: 138817 - DNA, 1169 bp, Homo sapiens
cttccccagatatcttcaaagcaactgctagtcctgcttttgcacattacactctacattctcattgccccacttaactaaccctccctcatgtccttttctaaagatgtagaagactttgaaatagcataacatttaaatggtcacaaatcacctggcttgaaagtgactaataataggaaaatcagacctcaggactgagttcaatttcaagattctcccactccactttgctaagagggaaacagaaaaacattactccagccacacaaatatgatactgtgcaagtatcccactcttactcattcaaatcctacccattttttcccatcgtggaacagagtcttgccaacttatacctctctccaataacccataaagatggtgatttgaatttgggccaagatttaacattttatgaaatacaagaggagagttttctgcaaaacacaggatttgcagacaaggagacttaggttcaaattccagttctgccatttattacctcagagaggtcatacaactttcctgaagttgtatgacctctctgagccttagtctcctcgtttgtaaaatgagagttaaaatctacctcatggaatcattgctaagattaagcaagatatataagtagagcttgtgcacatggtaggtacttggagaatgttatttctccttccctcttactcatctggacaagtttaactagaattctaaacagttaaatatgtatcaatcctttgtattaaatatcttgatggtaaaatgttaaaatattgatgtgaataacagctggtattgaatattcaaattaggggaactctttcattgttttaagataacatctgtacatttaatctgtgccatgcaataaaacagcttttcctgaaacagctttttaaaaactatttttaagaaattcataagttacttttaagaacattagcttagaacatcttcccctttcacaacaaattagacattagagccaaaattgcccaaattggtatagtttctatctccctacactttaatcaagatgtttgtctttatatcagcaaaaaccgctacttaagtgagattcctgcatcccaataaatgtatctgggcatttggtacttgagagaggattgggtttgacaacacccagaagctaatgaggatgtgc

SEQ ID NO: 138818 - DNA, 1567 bp, Homo sapiens
atcatcttcacttacattagtacatcagagtatcatcataaacatgtcagaatgcattgcattgtgtgttttgctaatgagtactaaggtaacattgccttttaagccaaattgatgctcttgattgtatctttatacatattttttttttttgagacggagtttcgctcttgttgcccaggttggagtgcaatggcgtgatctcggctcatcccaacctccacctcccgggttcaagcaattctcctgcctcagcctcccgagtagctgggattacaggtatgtgccaccacgcccagctaattttgtatttttagtagagacagggtttctccacgttgatcaggctgttctcaagctcctggcctcaggtgatccgcccgcctcggcctcccaaagtactgggattacaggcgtgagtcactgcgcccggccgatactgagtatttttttaacgaaatgttaggtgtctcaaataatatgctgtctctctgaacttacttgcagccagtcttgcagataaaatctgaatcaataacagaaaatagtactactgaggttgtggttacagatttgatcaccatatatgtctgttagctttacatagaaaaataatatattcagtaaccgaaaacaataaccctaaccccactcatgatgagagagttggaaaaaatggaggtctgatggaaattgatcgggattgtgaatatactctacatacggctagtggctgtcatattggacagcacaggtctaagcaattctaagtgtaagatcccactcctggctgagatgtgaataagagaaaacttgaagtttcctctaaaagttgtatttgtttgtctggttgtctcaaatgcaatggaaaccacagcatgacttttagcaggccccagaccattgccttgtgtgagttcaatcactgaatcttccttttcaaaagtaaaacattggatctggagcaaaatatagatttagaccccttggctattttctggggcggtgggctggcaggggagtaagctaaaaggttgcttgtgtatcaaatctgattcataatgcccagatttttctataatgcatttaaacaaactcagttattgggtgttcttaaagcagggcatacctgtaatagaaaagttgctgaaaatatagtctaatgatgatgtaccgctaatttccctttcatttgttaagaatattgtgttctggctgggcacagtggctcatgcctgtaatcccagcactttgggaggctgaggctggcagatcacctgaggtcaggaattcaagaccagcctggccaacatggtgaaaccctgtgtctactaaaaatagaaaaactagctgggcgtggtggcgggcacctgtaatcccagctactcgggaggctgaggcagaagaattgcttgaacctgggaggtggaggttgcagtgagccaaaatcgtgccattgcactgcagcctgggggacaagagcgagactccatctcaaaaaaaaaaaaaacaatattgtgttccttttggtatgggctgactttgatgcactcagtacttgcctgag

SEQ ID NO: 138819 - DNA, 1484 bp, Homo sapiens
taaagagaatggtggatggataacctctgtaacactggtttcaagggtttattaaatccccatagatgaagtgcaaaacaaacttctccatagaggagttgttgcaaagttccagtttataccaaacagtaatcagattccattggaagctaaagattttgagagccttttgtactatatgcaactaacttgatttcaagcttgggaaccttttaaaaaaaacattaaaagcaaaatgtaagtatataaggaataccaaatcaaatttatagactaatctttttctattaagtattttaagagtctttttcttctttataggaaaaatgctttctgaaagcagctcctttttgaagggtgtgatgcttggaagcattttctgtgctttgatcactatgctaggacacattaggattggtcatggaaatagaatgcaccaccatgagcatcatcacctacaagctcctaacaaagaagatatcttgaaaatttcagaggatgagcgcatggagctcagtaagagctttcgagtatactgtattatccttgtaaaacccaaagatgtgagtctttgggctgcagtaaaggagacttggaccaaacactgtgacaaagcagagttcttcagttctgaaaatgttaaagtgtttgagtcaattaatatggacacaaatgacatgtggttaatgatgagaaaagcttacaaatacgcctttgataagtatagagaccaatacaactggttcttccttgcacgccccactacgtttgctatcattgaaaacctaaagtattttttgttaaaaaaggatccatcacagcctttctatctaggccacactataaaatctggagaccttgaatatgtgggtatggaaggaggaattgtcttaagtgtagaatcaatgaaaagacttaacagccttctcaatatcccagaaaagtgtcctgaacagggagggatgatttggaagatatctgaagataaacagctagcagtttgcctgaaatatgctggagtatttgcagaaaatgcagaagatgctgatggaaaagatgtatttaataccaaatctgttgggctttctattaaagaggcaatgacttatcaccccaaccaggtagtagaaggctgttgttcagatatggctgttacttttaatggactgactccaaatcagatgcatgtgatgatgtatggggtataccgccttagggcatttgggcatattttcaatgatgcattggttttcttacctccaaatggttctgacaatgactgagaagtggtagaaaagcgtgaatatgatctttgtataggacgtgtgttgtcattatttgtagtagtaactacatatccaatacagctgtatgtttctttttcttttctaatttggtggcactggtataaccacacattaaagtcagtagtacatttttaaatgagggtggtttttttctttaaaacacatgaacattgtaaa

SEQ ID NO: 138820 - DNA, 1027 bp, Homo sapiens
gcctgggccccagccctctcccagcatgctccacgcgggatgcttgggcaggtgcagcgggaggattgtcagcacaggagaccgagagtcttcttcctgggggcgctctcttggtccctcagagggatatcgaggttaccatgtcctccctctcacttctcttccctatttcgtcttcgttttccgtacttcaccccaactaccttcacccaaaaaggttcatctaaaaaccattggggtagtttctgtttcatttgtgctcgtgtgcagttttgtttccttctgcacaaagtatcctatcatatgcatccctagtgttatattttttgcctctgtgatggggaaaaaatctccttagaataatttttgcaaattattttatttaaaatgtgtagacttactgagttttgatcactatttttgcagccaggagtaggatcaccatcaggaagaattctgacacatatgccataattgagcaaagaaacatgtgaattatgtattggccagaaataatgaaaactgcgtgacatgaaatacaaaaatcctatataaattaatcttagagtgcacctgacaattctttttcttttttctttctttctttcttttttttttttgaaacagagtctcgctcttgttgcccaggccggagtgctgtggtgcgatcttggctcactgcctgcaacctccgcctcccgggttcaagcaattctcctgcctcagcctcctgagtagctgggattacagtcatatgccaccatgcccggctaatttttgtatttttagtcgagacagggtctcaccatgttggccaggctggtcttgaactccctacctcaggtgatccacctgcctcggcctcccaaagtgctgggattacaggcgtgagccaccgcacacagccgacaattctaatattatgccgagcttgttttctgtcacttctcttcttggaactgtgtttattgaccaagttctgtgagtgacacaggaaagtcttcctgcctcttgccccacccaccgc

SEQ ID NO: 138821 - DNA, 1474 bp, Homo sapiens
ctgttggtgagtctgatgggagtatatggaatccagatggtattgacccaaaggaactggaagacttcaaattgcaacatgggtccattctgggcttccccaaggcaaagccctatgaaggaagcatcttggaggtcgactgtgacatactgatcccagctgccactgagaagcagttgaccaaatccaacgcacccagagtcaaagccaagatcattgctgaaggtgccaatgggccaacaactccagaagctgataagatcttcctggagagaaacattttggttattccagatctctacttgaatgctggaggagtgacagtatcttactttgagtggctgaagaatctaaatcatgtcagctatggccgtttgaccttcaaatatgaaagggattctaactaccacttgctcctgtctgttcaagagagtttagaaagaaaatttggaaagcatggtggaactattcccattgtacccacggcagagttccaagacagtatatcgggtgcatctgagaaagacattgtgcactctgccttggcatacacaatggagcgttctgccaggcaaattatgcacacagccatgaagtataacctgggattggacctgagaacagctgcctatgtcaatgccattgaaaaagtcttcaaagtgtacagtgaagctggtgtgaccttcacatagatggatcatggctgacttcctcactaacctcttcacgtgtaacttctgcagacctaccacaagtttacatgtaaccacagaaatccctttctctcctgactcattactaatggataccattctcaacaagtcaatccaaatcagcccgttaaggagaaagaaattaatatacaagctgagtgtgaaagtagaaatcacctacaccagagagctattttggtattttgcctttaaataaaaagcctcctccatatggctgtgcagccttgctctgtggcttttcccagcacaatcagtgctagtgctggggaagggacagtcaagagcagtcagttgcttacttattttgctctggatgagtctgggacacgctgtaactttaacacatttaagaagaaggtgtgtggccttttcagaaggtggcatggtcctcaagtgagttcttagtattttatatcagcaaaataactcaattttgcagattgcaaacaaatataaaagctgtttctgtttatgaattttattcttttagaatagaataagtacatgctgctgtaataaaattgcctttaatcacttaacaagcctaaccttgactcagtgaatgcctataaaaataataaatgaaaaaaaacagtatttttatatcataaaagtttcatttgtagcttatcattcacgtattgttgtccagcaaacattaaaagccctgtggataattacgttatcttcatacctgcaaaacggtggaggctattttcgttaaaactgtcagaattcgc

SEQ ID NO: 138822 - DNA, 1043 bp, Homo sapiens
gtttatgtgcatagaggttttcataatagtcttgaatgatcctttgtatttctgtggagtcagttgtaaagtttaaagtttaccatttcatttctttttttgccaattttaaatagttttatttaagacattgcatttttccatgtacaatagtgtttataaagtgcaatgttatatccttcccctgtgcatatgttccatattcaagcattaggaatgcccagtaacttactatagcagctgaacttttaaaaactgccacagaatttgctacaaatttaggtccttcaatgttttaaatgtgtggaacaatgctacatctatacttgggttggcttaatcaacctcttcaatggtgggccctgaggaagcaccaccagagggaggagctccaccaccagggaatcccccaggcattcctcctggcatgcctcctgcactctggtacagcttggtaatgatggggtttcagactttcttcagctctttctgctgatgttcaaattcttccttctcggcagtctgattcttatcgagccagttgataatttcattatacttgtgcagaatcttgtgtttgtcctcatcgttaatcttgcctggaagtttctcatctttgagagttgctttcatgttgaattcacaggaatcaagtgagttcttggatgacactttccctctgcttctgatcttcagctttgtacttctcagcttcctggaccatatattcaatgtcttccttgctcaaatggcccttgtcattagtgatagtaatcttgttcttttttcttgtactcttgtccacagcagaaacattgaggatgccattggaattagtgtcaaaagtgacttcaatctgaggaacacctcggggtgcaggaggtatgcctgtgagttcaaacttgtcaagcaggttgtcgtccttggtcatggtatgctcaccttcataaagctgaataagcacaccaggctggttgtcagaataggtagtgaaggtctgtgtctgcttggtaggaatggtagtattatgtttgatgaggtca

SEQ ID NO: 138823 - DNA, 1060 bp, Homo sapiens
tcagtagatattttaggggctctaatccatccggtttcatgttgcataaatcaactccaaatgatactgctgaggggcttaagacagtgggaaaaactcaagacagtgggcaaaagtctgctccaaatagtgtttgatgcaaaagtttcattttcctccatgctaacctagtgtgttccttctccaacactctctctcttttttttttaactggggaaaaaaaaagaaagaaagaaaaaaatagcacggttgttcagagaaatttcttcagatgagatttaaaaaagcagcagcagcttcttgattgagtcaattcaggatgtacatcacttgactgttaaagctagtgcctggctctaggaacgagctgaatttgacaattgcctaatgtgtaggaagcaaatatgagaaattctgcaaacaagtgaccttgaggggcagaacaggctgggttccctggcctctttctgtcctcaaatattaccttacttactgagagagctctgataggaactcataagactacaaactgattgcaagtgatgaatgcctagcaaactgaggggaggggagaaaatggtgatcaggtgatgatttagaaagctagttctgcctcccctagtgttgttcacccccatgatcattaaagacaacacagttcttaatttagagcaaagagggggcaggaggagaggaggcttggagcaggaaaactgaatatggaaagagaagaaattcatcaggcccaaagccggttctgaaatccttagttgtaccgggtgattattcctctgaaaaggggacattttgtaaaatacaaccaaaggaacctaaatggctaatagcctgttggacatatggttttacttgaatggaatgtttcgtgagaaagactgagaatacttcatgtaagcttatttcactaaaagttttcacaacaatgaggctgaatatggtataaaatatgctttgcttttatggctgatgtagtttggaatttggggtttttcttcctttctcttccaagggagaaatgatatttatgtttggatgggtgaaa

SEQ ID NO: 138824 - DNA, 1048 bp, Homo sapiens
agggtctctccaagggcacaggtttcttggctttgaagacttgggccaagaggatgggggtaacatactctgcaagaaatatgacagttgtcagctttaagaaaattttagctgaagatacagatccttatatgaacgtgttctgagatactccatatttgactttctttggctttctgacattgacaaaaataggaatttattaattccagctagtgtgaaagttacgaaatgtctgtctatactttgcatcttattttggtaatcccagcctgtctccacagcatttacaacacgcatctgactcttaatcctgcagcactgtgatcttgtcaagaggctgaatctcaaatgcagcttcctaaatatcaattagaacagatttaaaactaaatacattaaactaccagggtttattaccattagtaacaaataatatttatttcaactcccttcagtgtcttttcactgatgagaactgggataagagaaccatttggtttctcagaaatgattgatttccaaggtttttggtcctgttcttatggtcaaaccagattgacacccaccagccctggactgtcagaaccccactcaagaagcaatcagaaatgattcttgccatgtgaaaatctcaggtttaggaaaaggcaataagtcatccatattggtattgagttgccttattgccttacctctcagggcaataagagaacaaccaggggaaaggaaaagaaattgatcaaaatccctcaccgtaaattcatagcatttccacttacaaggctgggttgtggctaggggcttgagagttcgggagaaggagtgtggctcactgggcaacaagaaaaagaaaatgaaaacgtgaccttgcccttagttatgtcaaatacacatgtatgcatgcacagacatacgcaggaaaaatagctagaaaccagtgttgtgtatccagctgcctgttgctttctctgaagacagaggaggaaagctgtcatcttctctggtccctgaaacagtcatctctgaatgtcacaatcattgaatg

SEQ ID NO: 138825 - DNA, 1110 bp, Homo sapiens
tacatttgctcatatcattctcttctcaggttcctgttgatttttctctaagatgaaaaagcttaggtgagactgaaataaatgaacctcaagtccccagcctcccctacctcagcaacttgtcaagagagttggagattttttccatcgttatttttcaaaaccaatttcctaactgttgcatgacaatcagcagtcaaactaattggaatgttactttaacatttcttcctccttttagcattttttgtgctgtgttgtggggaggaagggatgtgaggtttcagcgatgcttacatagaaccttacctttcctttcctttcttatcactgctcccaactgggtcttcagcttcttgggtcagtgggacaaactacaagcaactgctacagtgtccctttcaacttgcatctcttctcatatctagtggggttttggggattgacaaggttggcacttctcagagatggagggaagggagaggcagtggttgaggagcaggaccagaggatgaagtgcagacttggctagtaatttcttgtaccttccatttaaccctatgccaagcctccaccaccaccaccactgaggagaaggaatgtcataattaaagaaggctctacgaatagcacagatattgtttctaaacaggaaaaagagtggtaggggaaggaattctattaagcaaacattgttggtttttctccccctgattttcttcgagaaatgtgtgtagggagagactacaatgaagggtcataatctattaaatacacggactaaactaagtatgccatctcaaaggaaaacataagtagtgtttaaaggtctggtctagtctcagctggtcagcctagaatccactggacaactgcacttcattactaacatctaactcctcaaatagccttttagtactatgtgatgctgctaaagggcaaaaggtgctgacagggaccatggacatttctgcagtgcctgtccccccggtagtgttcagatcttgcaaagccaacaaaactgcagcataggtcagctgcaaactccccctcatcagagacctccctgagccagcaaagtcaaggctgtgagctcagggccttcagaag

SEQ ID NO: 138826 - DNA, 1105 bp, Homo sapiens
gaagttgccaaactgttagtgcatttttcctgggtcatctataaacttgccttccttactaatgttttagaatgagtctacctctaatccccactttcttttaaggttcaagaagtagacctcactttactcaacagctgcattactgaaaatatgtgtatatgggaagggcaataccaataaacacacctcattgaatcgatctataatgtaaagaattccattattcagtaaacaagcataaggctgacctttggccaaattgaccagtaatacacagctgtggtcaaaatattatatgctcccataccagttggtaaatagctactacaccttgtcctggatgccagactgtactctgagatccctagacctccacaagatccagcagctaatacagtaatgcctgacacagcaaagggcctccgggtccttgctccagggctacagctggaacctagactgatttgttgtttcctgtgctttcctatgtgaatattatccacaatttcaaagctactgagtagcaggcactaggtgtggccatgaatgtggaccataattactttgcttaaaactgtaatagtgacactgaggtttgtgtcagttcactctgccccatgcattcccatggagcagaacgtccacgaccttcaaaagatggacgacatgagccctgtttccaaaatagcacttggcaggcagcctagatttggatgtgaacagcagacacaggctatgggcatgatgggccagccccctgtcacatcacctcaggggatcctcagcctcatgggactcactagaaaatcctttacatctgaaaagcagaaattatctagtccacctgagtgccctgggagtgggtctgtattcttagcctcatgcttccagtgctgagtttagaacaaaagcctctattcaaggtcatatggtgagtcagctactgaacagggagtgaaaagaaagggggaacaaacaacccacaacaggattagcttgagctgcctcaacctatgagaaaggcctggtcaaaccatttatagtcttcatatatagatagcttgaagaattgcctctgaagggtgttaatgaacataggtaa

SEQ ID NO: 138827 - DNA, 1899 bp, Homo sapiens
gtaaaataaacttttccatataaaatttcatttggagaaaggatttcaccactaaaaactatgcttgagaaacaagtgaataaaaaataagttccttctagctcaaacattctaagaatctaaaatcatagacattgtgggtgggtcaactcagtgttccattcaaccctacttttgacagccaggaacaggcctaggatctgctgtgaaaggcccttcacaggtcccccatgccccagcttctttcagaggccattaacactgtcctcatatggcagttgtcttccccattgggctaatccttcgcaggccttctactgatgtctgtctatgttggagtgggtggagcacaggggtcaatatttgaaggacagttgtacttctgttttatatgaaaggagtcaaatgtttcctgattttcacctaaaactcttcttattgatgtccaccaccaaaagacagtggatctgccttttggaccacggtggcatattattccctgaggattgccactgatctataaatattcctgagtcccttgtctgagtcacaaccagagctgtatgcttagtttggaaattttaaatttcagtgggttttctcacacaggctccctacacatttttataagttcttcttttgtctcattcttcttgtcataatatacaggcttaaagatttcactgggttcaccttcctggagacaactcataaagttttaccaaagtctgggtttcacatatacaatatgactcccttgatataaagctttaaaacaagcaaaaataataatatatcgtttaggtgtatgtgtttgtatatttttttaaaaccaaggtaataataaatacaaatttcacgatagtagttacctggggcaggggtagcagggaggagtgttatcaatacagggagatggactagaggaggaccacatagataaaagtaagttaccagtaatgttatagttctcaggttgggtaatggctttataggtgttcattatagtctaaataaataaatgaatgcaataaataaaatattaaaagtccgtgtatgaactaacaatgattaattaattctgcaccccgagttcaaggtcaatgattagaagagcaatacaagattttttttaatcaaccagaacctcgccacttatcttctgtttccttccactatttcaagagtttttgaaactgaaagtggatcatggctatagttttccttctttttaagtttatattccccctcaattattgcccataatctagtcaggttggagttctccttactgaaaatatgttgcattttcccatgagactatttttgtataggattcatggatcctaatttttcttttgccagttggtatggatctgagaattaccagctaccctttgaatcattttggttgaagggccatgattgcttgttctagtcttccagcccatgaccattattagtaaggagaggttctttctagggttgacagataaaatacaggatgcccagttaaatttgaatttcagataaacaacaaattatgtttttagtgtatgtatgaatttgaggcatacttatactaaaaaattatttacctgaaattcaaatttaattgaaaatcttgtttttatttgctaaagctcgaaaccctatctcttgtggagcaatgattactttttaataacattattggatttgagtacatgtgagtgtgagttttggatcaagcacactcagattcaaattctggctcctctgcttaatagctagaacagtttttttggtctcagaatttttatctattaaataggaataacagcaatacctcataaagctgatgagaatattaaatgaaaaaatatttgtacagtagttagtatagtgcctggctaaata

SEQ ID NO: 138828 - DNA, 1052 bp, Homo sapiens
aagtaacttaacttgaacggccattttgctcttgggaatccagaacactcttcactttactctcattttgctgcatcatcaaatcttaatagcaaatacttaggcctgtatttccctattgtacttacctccaaactatcatcaaatttcatgaacctgaagcagaagaccagaggtctagtccaagctctgccacttactagctcacttaacaagttgaccttgaccaactcattgacatgctcttggacttggcctcctcacctaaggtgtgttccttcttaatgttatattccatgattctgtgattttttttgagatatttgaccagctactgacactttgtatcttgctactaatcgtaacttatatattatcagttaattagtcaatccattctacaagccattatcaacccccaatggtggtctccaatcctgtgatacatacatatataatatggtttcaagggggtgtgtacagaaaaagatacttataaagcaattcatgaacaacacagaacaacatcaaattgagtgctacactgtatactctgaatactttaagaattgtggaaaggttgcactccagaaaagtagagttttcagagaaagcttgctagagaagctagccttgaaagatagataagttgtgggttgcaagagagaagggagatggggctttggagaggagaaaagagaacaaacaaacagcagggccaggaaggaacactgtgtgttcaggtagagccctgtctgactgagatacaaaatagcttgaatattctaattcataatttgccaaattttaataaatttcattttgtccaaacagtatacatgtactgtatacagcgtaatctagtgcatatcaatttcgttttcagaactgaactttgtaagtcaggcaacttctctcctgaaacattttaaaaacgaaatattggttccaccaacagtgtacctctcatttattcaaaagcagaagacacaattaatgaattttatcctcatctagtgtgacccttctctgctcattagctctctactaga

SEQ ID NO: 138829 - DNA, 1045 bp, Homo sapiens
ctccagtcctccttcctgatgagaggcagccttgtataatgaaaagatcccagatcttagagtcagacctaagttcaagtcttaactctgcaacttacaaactgtgtgacttaggttgggcaagcaggggttctcttttttatttcttcatttttaaggctgggaaaatgatttttgccttggaattcttgtcaattctcatctgattgttgtgaggagtgaatggaaacactctatgtataagtcctttgaaaacaggtactgacaaaacgcttttgaagcattaaaatgcatgtcttcctgagagaggggcagcacagtcaaccagtcctggttacctggtgtatcacataactgttctccttgagaggggaagatggtcccacaagaaagctaggaatatcagtggtgggtgctgccatcgggcttatgtggtggggacgaagggcccaggcaaagaaagctgtgacttcctcccccgactaccaaataaactgccagctctagcattttgccaacgactgatcctatgacatgagctcagagcaggaaggccggactgtagggaggaggtacggaagactcccttgaaatactgcgggtggcattcaccagctctcaaggaagagctccaagtttagggggacaggtggccagcggaggttttgaatctaccagaggaaattatcctccctctgtgtgcccaggataagatctcagagccagggaatgtttgtaaatggactctctcatttaaataaatcccacttaaatatttatcagatcatgaatatgcatgtttctctctctcagtgctggaaagagaacgggtgtgtaatttttagatggcacataaataatgtaagggggaaaaagggatctttgttctgtgttgactgtgtatttacagcatctcaagaggtcttgaaataatgaactgatttttccctttcccagtctaaatgtgcacttggagcttcacctgtcctgtctttagggtgatttgcacacatttgtatccccaggggaggatttctggaggcaa

SEQ ID NO: 138830 - DNA, 1035 bp, Homo sapiens
catattataatgaggcgctatctctactgaagttatttctaatttgccacaatgcttatatagaagatgaaataaatgagcttcaactgcagtaaggaaattgcaggcagttgtaagaagttcttgattttattccatagatattttgagagtgcatgtcaataaaaacaattagataatataattcagctgtgagctctcatgtagccacttgatgcggggtgcccaaaagttgtagaatcttctttcctttgcaacaaaatgaaagtgcaaactgtctggagggttaaggctgaggttatgagtaagcctgctttccataatggataaggttcaaaggcacctgatggactgtgactagaaattcagtagaatctttaatacctacagaaagatttttaaatcattgaagctgtttttccttccttcaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggtacgtttgagatttatttcaccgccagccaacatgttaaattatcaacctaagtcagctcccatatctgctaataaattaagtagccaacagactaaacgtgccaacagtttttgatagtctctctaatccttttttcctccccagtggctgcagaaaaaaaaaaaaaaaaagaaagaaagaaaagagaagaaaatctaagctgttgaaaattgcatgccatgattaatctggaagtatttgcaatttaatgctacctatcagataaacatatccctccacacctctgtttcatagacaactgactttcaaagtaatccccttcctttcccataccttcttcccaacagggaacagacaagggactaagcagtgcagatggaaagggtttttgtttcaggagcctcattgctgga

SEQ ID NO: 138831 - DNA, 1040 bp, Homo sapiens
catttatatgacttgtttaaatgtaaccctctgctcaatcctagtaagtggcagagcaaggataaaactcaagtcttctgattcctcatacagttctcttgcccctacactgcactacctcttttaatttgtaagttactcattaaataaatatttagccaatgccaaaacttggatttggcctgcttatcaggttaaatcttaaaacagttgcaaaacaattagagaagatccaaagaagagcagcaaaaatatgattaaagtgttagaaaatggggcctgtgaggaaaggctaaatgagttgggattgtttagcctggtgaaagagagccaagaggtagtttaatcaccttctcaagtataaagagttatcattaaaagggcactgaccaactgttctgcatgcctaaggacagtaccagagcaaatgagcttaactagactagagagagagtcagtattagaaatgactcattataaaacagagaggaaatgaagacagtaaaatctcaccagttcaggctatatgaaggtgaagccatactgaattagtgaaaagtcagacctagatatgtcttaacattgttttcaagaatatacaaatattccaaattaatcctgtgtgttgacaagtaaatatccttatagaagacttatttaataaatagacttatttaataaatagtattttctaatttgtctattcattatatatctaaaaggctgtccccttaaaaagatttacacattcctccttcagtcttaaccatgtttctctttattccatagaaaatttacagacaagtctcagcatatcctctgcctaaattatagcatgtgctaatctagtggggcccaaaccaatatgtttcaatgttctacctaaaatattatataatgtataatttccccttgagatattccaggctaaaatcacttcatcatggatgatgtgaaggtagcatttcttaaggacagattcctgaagcaggtcaatccttcaggtagatttcatttcagaaaccccggctgtcactttg

SEQ ID NO: 138832 - DNA, 1065 bp, Homo sapiens
cgagcttccagagtagatcaatacatggccaaacaacccactggccttccttcatctcttactgtattttagtaggtggttcccttttttcccctgcctccagccattccaggtgtctctctgtaagttggttgccttattcttccttttcaaggacactttttgttacctaaccaatcatggtgtccaaatcgtggtcactatttcttaatctaatgacatggcaatttgatgctattacttaacacttattgggctacctgaattaatatcttgaagcaataatgcaacccaaactacagaatggtgtcccaaaagcaaaacctatggttggatttcttaaagatgttcattggaaacatggtttcttaagtctaacctagtatctttaggccctaagcaagcgagactctacttgtggtaaaagccttcaacaacatatgttaggtgactttgacactcactgacagccttaaataaacttgttctataaatgcaaagatatttatcctaggagttagtagcagacatcaatattctatatttaggaattttatcttcagcttattaaaaaagatggcacaattctctggtcatacctcacactagactggctagactggctttgtgactgtttagaagcaaatcccctctgggaaaataaagagaaaaaaaaaactttttcaataacattactttgaaacagcaagactcttgtttatttcagatgatagaagctttagggtcaaaaaggaaatgttctacttaatcaacagttccctcctcccattaaacaaaaatctgataaatgtttgattatttcttgtcaggtttggggggttttatttttaaaataaacacaaattcaaattaattttcattagggaactttttgagagtcgttgggatgactgaagacaccttggggttttgtaaagcagagtacagaagccttgaggcaggagagctggattctagccccaagctgtatgagttcaaaaaatcaatctctctacatctccatttcctgaactgtaaaatgaatctatggaatatgatggtctt

SEQ ID NO: 138833 - DNA, 1095 bp, Homo sapiens
attaattgttcataaaagaagaatagtatattcaagctcaagtggtttagctgaaattgttttcatgcctttaattatctcaatagcagaaatcatagctctaggtataactggataattagtggggacagagaaaggaagaatgggatccctttcagagttcagcattgggccagaatgcgcctgctgagcttaagaatggggacacagaaaaaggataactaggtgaacggatttgcaaatcagaacctggggattatgctatctaaaagacatacacatttgcgaggtaaataagagaaaaaccaaaatagagtgtgacctcagtaatactctgtcttggattaagagataaggatctagagacactgaaacaatggactaggtagccaacgagggtactgtagaaagcttcttagtgggcacttttaagtaccttgccatcactatcttttgaacagctctgagggtccttttcagtcctcttgacctatttcaaactactacttgtgcttaacttgaaaacttcctactcaacaaattgttcctcctgcttcctttgaccaacataaaatcaattgttgtttgacagaatactttgttgctgttttctcaaaggtgcaaaggggaaaaaaacaccttatttttgcacacattaacttaatttcagtcttacctactcaagcacaacataatccttcaaactctgaccgaagccccttcaccatttggtgtccatggcaaccgccaccaagccactcagagagttgcaagcagtggcagaaaagtgcatctcccaacagagccattagctcttctgcattaaccccatcaataaaaggtggcagcaggcccagccctgcattttctttcatcagggaggaggaatgttgtccgtgtttccttcccagattgtgagaattgggtgtggctacatctcacacccaacctgttgaaaataaagcattgagggtaaattactgcaactaagtcagagaacgattttcacttgagaaaacttcccactggtatgcttccccaacgactctgtcaactgcagcctccaccacaacactgcttgctaaactacagcca

SEQ ID NO: 138834 - DNA, 1038 bp, Homo sapiens
ctttcatgtttgcatatgtcatatacagtaatcaacaacttattttttaggcatctacagtttctttagtttagaatctgttgcagtgatacatacaaaaatagaagattgagtctctgccttcaaaaaacctgttttaaaagatatgctttcaaaaaaattcaagaataacataagacagcaaacacctaagaattaaactgctgtggccctgtgtggcacctcatggtgtagagtgaagcagatataagaagtataggatattatgcctgctccacaagaattttcagtcaagtgagggagataagacataagaacacgaaaattaaaataagaaaacgagagttaaatagtgacatgtcacaaggcagtacaagttgtattataaggtagcaaaaacacactattaggaaaagaaagcagagtcggttgctctaagccaatgtgtctcagaagacaaaaggccagcaccctttctttaatttaccatcaagttaaagcactttagaacccactgaatgctaccacttttctaacctaagcattgataattcaattggttgtaaagatttaggacttgatattttcaccaaagaagtatattaagcgacaaataactgattaaagactgtctctaaaagtcatatatgttttcttttttttcttttttttcagagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgt

SEQ ID NO: 138835 - DNA, 1027 bp, Homo sapiens
ttttgagacaaaaaagctgtaggttttggtaaacttgaacattaatccagatactgaccagagtcaattatacaaacacattagggattttcatgtgaaatataaagactcagaagagtcctaccatgtttttacagcatacttcattttgagattatccacttggaccataaaacatttaaaaagaagctttgcagcataactaattggtaaccatattcagcagctttttaaaatagtctgtatggggtatgcctcatttatcgaagtcacactttttttggcttttctcaatctgcttgattacattctccaaattatttcactccctgttccttttgtgcttagaatgtatgtcattttttgtattatctgggagtttattttgctagtttctttattttttgaaatgttcacttcaagagactatggtttctgaatgatcctataattaaatgatttttaacatggctggtaatctatgttgagacaatactaaagagtcattaaggctcaagattttattggtttctgtaagtgaattttcagaactaagtttgtggtatccccattggagtgctgcatactactctgcatactcaaaaagcactcttctcatttttagaagaatttatatatatattgattcattaagtaataacttaaagattatggcctgaaaatgacaagttgaacaggtttgttaatgtcttatagtagaatgtaagctgtggctcttctttggcactgagatatatcaaatgctttttttcaaagtatgtattttattatactaaactagacactgtcataaagagcaatggctttcaaaattttttttaccatgacccacagtaagaagtaaattttccatcacaactcagtatacacatatgtatataaccaaaggttcaccatactttacccttacaatgtgcaatgcactccgatattttctattgtgtcattttttttttaattctggttacaattcaacccagaaatagggcacacaacctacagaata

SEQ ID NO: 138836 - DNA, 1022 bp, Homo sapiens
agacttagctaaacagactgaaattgcatatgggaccctggactccggttcaacaaaagaatttttcagagtaagtgctctgcagttaattgagcctgctgatatttattttatcatcttctcacaaaggcaagttcacagtgcttttaagggagagttgggaaagagtgggaatgttatcaaaggagagcatcttaaatactgggctgcttggttggtgatctactccattgtcgtttagaaccaagacttgagtaagacataacaagctgcatgtcaagggcactgagtttggactcccaggtttgaatcccaaccctgccacaaagtgattgtttgtccttgggcaagccatttaacttctaccagcttcagtcccctcacttgaataatgaggggattgaactaaataatatatattctgctttctagcttttacaaaagcagtgcttttatgtctcagaggttcacagaagttaggcaattgactctaagactgatgagtaatggactataagaaattacatattctattttaaatgttagttgtctattgagatgtattacaattgtatcaagtatttgtgtacatggtgataatttcattttcaggacagctgataattgttttaatttcttgggtagacgtattccctcagctcctcataggcaaaatcttattgaggaaacagtaaattgttcattagcaaaagttaataaagctatgtaaagtctgtcaagaggaaagatgaaaggagattgaagcaggaaatgatagaaggataatatgagggacaaaccactttcacataaaccatcaagatctttattctgtggtaactggactattaaggaagaatactagtagagtttttaagaactaaaatgttttttcagttaccccaacaagaaaaatatgctaatttagattagaaaatggacacattctataatattactactgcctgctactgtaaccacagtaactagttgtagcaatgatccagaagccacttgggtag

SEQ ID NO: 138837 - DNA, 1044 bp, Homo sapiens
ttaaataaaataaaataaacctaaagactctccagacacagttctgtagagatgtgaggggtacttcacaaaaataaaataagataatctctctgctttcttgatggaagagatgtgggtttgttttttgtttttgtttgtttgtttgtttgtttttctggctttgggaagagaaagaaagctcattcaatattttccccatcctcttgatcccacttctacccttaaatataaaatattactattgtgctcatctcctagttgattcatctttagctattcctttgtggcctgcagattcaacaacttcaatatgcacaatttagagctgcccttgaagaccatctagaaactttaggtgcttccaaggtggcctgccggccatctgcccaaagtaaccaaccatatggattttattaaactatctccattagtcctccaaggtaacctacttgtttatgagagcgtttcacagcccagaaagcctaagggggttaagtctccattctttctgaggctgccaactctcacagacagcatcagggtaattaacatcacacaggacccccagatctttgtaagaactctgaaactctgtttcctagaagaactcatctaaggatctcactttcttttcttatctgacacagtcaaatcatctaatagccttccagttaaaggaatgaggcccatctcttcaattagactttacttgagttcacctggcaagcctgtgtaggttaattatttacagtcctccttcatgcagaagcctaaaaacttgaccgtaaggatcaagtaaaattcgacttacgaaaactcaactaacaaggacaattaactggaatgcttggttgcactccacttttgaaaggaaaaggcaacttagacacacaaaaacttgataagaattttttccccaaaagcctactagatgatgtcctgcagtcagattcattctagtcttcaacatcattcacactttggtcagagagtaaatgtattgaatgtttatcatagcaatttaggcaccaggtatacagt

SEQ ID NO: 138838 - DNA, 1049 bp, Homo sapiens
attccatggagttaaataagacggtaaattatggtttcatctatttaatgcatccattttttttaatgttctctctctgtgttgtcctctctgactgtttgttgctgttttaattttacagttcaacggctttttcaatttaaatggtaaaagccaagttatggtgccatatgtgacgaatgttaattgcatggatgtggtgttcttgttactttttttctcaaagacaatttccccatcccgcacacttcagttttgagcaaatgttatcctccatgccaccttccaatatttaaccctgtatttgctgtacagacatttttatagctccacgttctgtgaaatttagccaatttgtcctcttgtgctcctttttatacgttaacgatttcctaagcatttgtgcattttcttacaagttatgttttatcgtttcaagaaatgctgttaacctggcagtattaaaactgaatgagcaaggcctcttggacaaattgaaaaacaaatggtggtacgacaaaggagagtgcggcagcgggggcggtgactccaaggtcagcctcaatgtcaccacaaccgggtacccttagtgacgagtaatcggcaagactgttatcttattattgaggagagagcacaagactcacacataaagtggaatgaccaggttattcccctgcctggcagctttgggaaccaaaaagactttagggcactgcccacatttttgatctaacttgggtcccttcttcaactcccagacagaggctccaaccacaccctttcccttcctttacccaccagtttggttgccttatgaaagccatgatgtgggtttcaatgccctaggctttcaagagtccaaggctttcctgtgagactgtccccgcctgcctcagttgagtggtatgaaaaatcagatccatctactgaaaaatcagggcatagccttttgttttctaggttgtgatggttgctcacagaggttggttggttgagtaagggtggcttcttcaattatgtgtctgagtgatgagatgttgttctct

SEQ ID NO: 138839 - DNA, 5886 bp, Homo sapiens
caggctggtattgaactcatgggctcaagtaatcctcctgcctctgcctctcaaagtggtacgattacacatgtgagccaccaccgccagcaaaatgcaccttcttaacctcacacaatatttcaaaattttaaaaatctgtttgtttttaaaaatcagaattgacaaaatccaaatttcagtttttcttgaaggattggaacatctggtaacattgtgttctgatttctgcatagcatcattatgtcctgatttcagctagacttgtctaggtgctgcccccctttagaatagagcaagggcctttttaaaaacagttcacctccgtcagtccccactcagctcgtttcttttgttttcatcacgttcttggcctttgtagacaattgattttgtaattccagctctaagcctttttttgtttgtttgttttcccttcagttcatacttggaaactgacctcctaagctcctgaagatttcttgttttaggaatgcattgccattctgaggcttattcctagatgttgacgataggtattggtaaagggtatgggatagggaactcatcaatgttcacattgatgccagagaaacatttaatatctctgtataagtgcaacattgactttttttgccaccaaacacaccattttataggaagggaacctatactgattaaaagagcttgcttatttgctgcagcatattttttgagggcagatttaatatgctctcattttggtctgtatgtagtaaccattaaatgtatactagactcttgtaaggagcttgaaatgacagacacaaatcatttctgtcttcattatcaacttttatacttaaaaaaaatactgagtataggttttgtgcactgatattcataggcatgaaaagttgaagagggcaggagaaattttctatttccttgctcttccacttacggtagagcaaatattcatttatatgctgttttttaaaattttgacatgggcatgagcacttataaaaggcttccatacaacatttgccctgagtgtgtctttcccctacacacataattatcctgaaaagcatccctgggtgcagttaagtttcagctcaacagaatccacgtcttaactctgttacattttatccacgtggaacatctcaggaactctgtttgctataaagaattcctaggttgcagtataagggtaaatgaaggagtaaagtggatttaggatggctgtccccatgtctttctcataacttctttcttccttataaatatttgtttgactttttaaatgtcaagttcatctttatatgcctttctacctggggtttatgtgaaaagaacgagagaatgagaataaaatcctgacagtttcagacactagtaaaaatgcatggaatgcagttctgggatgcttcctgtgaagtgaagacacttaaccaaaaataatatattattttggtgggcttgattttatagtttctcttaaaaattgtttggttgccatccagagggctcttttatgaagaatctatataaactactaaaacatttcttaggacctttttggtgaatttgatcataaaattaaaaagcgtgtatgtgttttataaaggcatacctctgttaagaaggctggttttatgtttgccttttcttctctactttgatcaccaccctagctgttcctttctccagaccaccttacttttcaaacttgattcttgctatcacagctctctgtaacatcagttaaaatcagctgcctcaactctttgaggatgtttgtgcataggacggcattgtgaaacatagggaaatggcagtcttactaacaaaacaggacctatctctggccaaaaagaaaaaaaaaaaacaaacaactcaggaggtccagataattaccaatataaaatggcgttcacacatataatcttgtctcagcagagtaggaaggccatcttctgttgagatgtgtcctacaaatgtggtatgtgatattaccaatacagcttatagcaccaataggtgtctgtgatggagaacagcagactatgaactgagcctggagtagaaaatttttgagaagcagcaacagtcctagatgtgaaaaagatagatctgtgtgatcccttacattcagaacttacactttcttatttacaatggttaaagcagtacatattaaaaaatagttaataaaacacttaggagaatgttgcaggtaatgtggtataaatgttaataagaagaaaaatactgctttgctgaaaatagagtcctgaaggctgagtttggcactgcttcatcactatgcaactttcttcttgatgacagctagctctttctgaagttcagtaaacttgggggcagttttcaagtttgtaatcctaacacctcagcattattttattaaaatactctgtggacactgccaagagactgacatccagtatcttctttccacttgctcttgtggttgctgatttgtcattccaggctatggacagaccccctaagccgaaagtctcccagaggaggatgccaaagctccgtgcgtcactctcagaatgatatctcccataattaagagcttctggtgctgtccatttaatgggaatctgctttaagtcagaagatgagtacacaccaccatcctcttgacgagacattccaaagtcactgattttcagaacattattttcacctccaggcagtttcttacagcaaggtccctgtgtatacattttttactcgagatacaccatccagaatcagcatctaatgaaaatttcactgagttttagttcattcttctttctctgaaaggagaggaaatcgcctccaggaaccagttccttaatgacgtagataggccgtctttgtgtgtgaactcctatacttttgacattactgggatgattatattgcttgaggattttggcttctagtaaaaattttaatttcagttcctggggaagacgttcttgacgtgttttaacagcaacagcaattttatcctttaatgtgaccttaaatgtgtcaccaaaatttcccttgcctcttgtaacgtggcacctttatgattgagaacccatttcttattctcctaatggccatactgtgataccatgatgctcttaattggaacattgactttttttttttttgcaatttaaacaattgagataaaattcatataacatcaaatttacctttcacttttttttttttcttttggagaccaagtctcgctgttgtctcccaggctggagtgcagtggcgcgatctcggctcactgtgacctccgcctcctgggttcaagcaattctccttcctcagcctcctgagtagctgggactacaggcgtgcaccaccacgcctggctaatttttgtatttttagtagagataggggtttcaccgtgttagccaggatggtctcgatctcctgacctggtgatccacctgcctcggcctcccaaagtgttgggattataagcgtgagccatgacgcctggcctcaaacttgccatttttaaagtgtacaattcaatggtttttagtatatccactatgttgtgcaagcatcaccgctgtctaattccagagcatttctgtcaccccaaaaagaaactccatgcctattagcagtcactcccagttcttcccttcctcggcccctggaaaccagtaatgtactttctgtctctgtgattttgcctgttttggacatttcatttaaatggaattatgcaataatttgtggccttttgtgtttggctttcacttagcatcatgttctcaaggctcatccatgttgtggcatgtatcagtactgcattcctttttatggctaaatgatgtttcattgtatgagtgtgtaccacattttatttatccattcagcaattaatggacaggaacaatggcttttaagtattaaattgtaagttcaacattaaatgtatccacagttattgataatatcaagattatacatggtgtgaacagaatgctgtgtcgaaatggtatgtaaattatttgtcagcatttcatgtaagtgattattttctaaggacccttctagccctggttttaagaaatatgtgaatgtagtattttcatcaataaagtttaatgcattaagcattagcttaaaatttgaatgaaggcagatgtgaagatatttgccacatgttgtaataatcatgttttgaaattatttcaatatgaagtatttgaaaaatgtcaatacataaaggaaaggaaatgagtataattaagtcaatatatttttaaagcaatttttataatttagcagacactgcatcttaatataagttactattaaaattgtgtccttgtgaaaaatgtgatgtcattttcctttttttgttgatcatgtaaaataggttacttttctttgctacattttctatttaataagctattgcttgccgttgtggaatgttttacttgttgctccatttttttctccctacccccacccctctctcccacacgcacacaatgttcaattttttttttaagtcatcattagtgtgtttatctttaatggattctaagaatggacaaaaagaaacacacaaatatttcatccttttctggggactcaagtctttgttaccgatggaactcattaacttcttgttctttcttaaatcttcctccctccttaccttttcctctccttccttctcttcttcttcctttcttctcccctccctccctccctcccttcttccctccctcctcctttcattctccttctctccttctcccttccttttctcctacctcctttgactaagcctccctcccctactccctcctttccttccttccttccttcttctctatcaatataatcactttgtttctttcaggtgagatcggactggaactgttcggctgcgaccagaaatttattttcctgagtaaattgccgagaattaagaatgaagagggccatttgcatctccttaaattattcagttacctgctttattgctccatgtggaaaacttaaaattgttaagttgtgcattactgtattttaacttgttgcttagtttctacatgtttattttcagtaatggctgaaagtgttaactgttccatacttttagcacaatgtgctgcataaggttacctgtgtacagagttttactttagattaactaaatattgcctgggttcagtttttatttccattctgaaatgcttcctttttattgtttgaaactgaaaataaacaattgttgaacccttttgattttacctcattttaaaactgttttaatttattatttggcttgttcttaatattagtcactaaaagcagtgggagcattgtcttatgaaatgcttaggaatcattttatatagtacatgtacaacattaaacgtgtttaaaaaagaaaaaggtaccagcgatcacttgtcccttgccattttttcttgtaattatgttagacaaatcttggcggcggggggatcaaaacataattgttttaattctacagctgtaggagctttgtattgctgaactttcatctggaaaagtttcacagtgacatttttaaaagagaatttttttatctgccgaattctaccagtgtaaccttttttctaaataaacaatagttttctcaaatggttgtatattattgtgtatattgttgcttattcagaataacttagcaaagataattcattaaggttcctagcccttctcagttcttattccatgggctacattattttccagtgacatatcatccaataataggaaaatatcctgtttgattacctctgtagttggagtaaacagtggacttggtagcatgcctggatttttcca

SEQ ID NO: 138840 - DNA, 2872 bp, Homo sapiens
agaaacaatatccttttcattttgatgttttcagttagtgtagtagaaagctttgatactggtcatgtttacaattgtactcttttagtatgtggtttatatgcttaagggctgattagttttgaaatggtctttccagttaactctcaaaatgtgtgaaatctggaagtgggatacttgatgttcttgatatttaaaaatacttctgtggtgactgagatgttttatgccactaagggatttatagtctttcaggttatattatcacagagaggaagaaagggaacagagagtccctagggctggggacattgggaatagaagggcaaaatgatgagtcagacaagcagagctggtagagtttgaggctaccaggctggtcagagcccatttaggcctgcaacctgaggtgctgtactaaaaggggagatgctgttctttccgccattcccaaaagttgttttcccttaatttgtcatctactcataagtcctcggacaagcacagataatgaagactttccatcaaggtgagtgttctctcaccaccttttcacttaatgatagaaacataaaatgagttctgataatgttgaaaaactagatgcattttacaagctacaactacttgtttttttcacctaaatataacgaccaagtcttcgggtatagatgcaaaacaagattcagagttatttttaagctgttttcattttaagcttgctgattagccacacattttttttttaagcaccaagatatatttaagaacatctggctttctcttcaccacttattcccatcttctctggataattaattatgtttttaaagtccttattgccttgtaaatggtggtagtggtatctgcattttataagtgaagaaacagactctgagaggttaagttgaagagggtcataaagatattagtcaacagagccagttgactatcctcagtctttctatcctttagtgttctctgttccttttgctttctcatgctgatgtcttatccaaagatttttaagttttcgtgccattttttttttttttaccactgcccatgttttgcaacagaaaatatggtctgtgtttttagttctggaatttacaatgtgtaactttttttttctttttttttctttttttaggtaatgcacttaatgctttatgtgagatttaaaaagtattttacccatcttaaataaattgtgtttccatcatagtggatacagtgttcagaccctaacatcgccttttttgagcacttaagataatctgaatagttactgtttggtgatgccttagtattattgaagtacgtaggacaatttgccccctaaatgtaatggttccagacagctgtgttttgaggctgttgattctgcctttatttttttatttttatttttttttgagacagagtctcactctgtcgcccaggctggagtgcagtggcgcgatctcagctcactgcaacctctgccgcccaggtccaagcgattctcctgcctcagcctcctgagtagctgggattagaggcgcctgccaccgcgcccggctaatttttgtatttttagtagagatggggtttcaccatgttggctaggctggtcttgaactcttgacctcgtgatccacctgcctcagcctcccgaagtgctgggattacatgtgtgagccactgtgcctggccgactctgcttttttatagcccgttttcttgcttccatgttagccatcatttcttaatatattaagtatacttgcttttctatacttcgttaatatattaattaattaagtatccttgcttgtctatacctcccccctaatattattggatgcttctaatcttttatgagaccagatagataaccaaggctgtttaccagtgtttaaattacaagtgagaaatgtctgagagccagttctgtataagggtatgggcttaaaggtatggattttgtcatctttattttggctgcaaagcagggattcgagaggttgccttatagtcaacacatgatgaatggtgtgcttttcctgcttttttggtgcttgctatgtaagtagattagggtaaagtagggtaaatgagagttataaaagaacatttcgaatttaatagatttaaaaggaaatattactgctaattcttcaattctagctgctcctacccccatcccaaccttacaactatcttctctggtgagccataaactcttaatcctcattttaacctttcttttaatctggcattttgctgtcacatgtggtctccctattaaaagaaaaacaaaaagcccacctttcatatcttcatgaggaatgagccagccattgtcactgacaactttcacagtgattttatatatctctgtttactcagtacccaaatattattcttttgtatgtgaaggttatgctacagatttgagtttttcttgcactgaccatgaatttgtattttacccctctgtgtaatctcttaggaacaaagggatgacaaaactggtcagggttagatatttggctcgtggtcttatagcaaaacttctagattcagatgttcttttaaaagtatgtctagctggatgtccatcctgttgaattcctcattgacaactttgtacgatactttcttcttgggtagactcttaattttgtgagactctggttgatagtttcttttcttttgagacaaagaagtctcgctgttttgcccaggctggagtgtaatggtgcgatcttggatcactgcaacctctgccttccaggtgattctcctggtgattcttcaagagattctcctgcctcatcctcctgagtagctgggattacaggcacgcaccaccatacctggctaa

SEQ ID NO: 138841 - DNA, 1171 bp, Homo sapiens
gtgaatctcacgcatctgccataaagtaataagcaagccattactaaagtataaattgtttccaaaacattgttatatatattgaaaatatatgccatttattcatagttcataaaaacagctctagaaaattatataatgaacattttaattctatgctttaaaagataggctgttcttttaggtgttttttaattgaggtaaaattcaaataacataaaattaatcattttacaggtgtacatttaagtgacatttagtatattcacagtattgtgtaatcatctctatctagttccaaaacatttttatcacctccaagagaaaactctatacccatttaaacagtcactcccatttccccttctcagcccctgggaaccataaatctgttttctttatggattcactcattctgaatattttatataaatgaaatagtacaataatgtgcccttttgtgtctgatgtctttcacttagcataatgtttttgaagttcttccatgttgtagcatgtgtcatttacttcatttctttttatagctaagtaatatttcattatatgaatataccacatttgtttatccatttttcagttgatggacttttgaattgtttccacgttttggctattgtgaatagtgctgctgtgaacatttgtgtggggctataagtatttgttcaaacacctatttttaattatcttggatatatgcccaagaatggaatttctgggttatatggtaattctatgtttaactttttgaggaaccaccaaaatcttttagacagtggctgtacagtttacatttctaccaacaaagtatcagagtgcagatttctctacatctttgtcaacactggttattttctgtttttgttttttattatagccattccagtaagtgtgaagtggtgtctcattgtggttttgatttgcattttcttaataactaatgatgctgaacatcttttcatgtgcttattggccatttgtttatctttcaagaaatctgttcagataccttgaccattttttattttgagggtttgtgtttttgttgctcagttgtaagagttctttatgtactttggatactagatccttatgagataggtgatttgcaaattttttctccagttctataggttgtcttttcactttcttg

SEQ ID NO: 138842 - DNA, 1486 bp, Homo sapiens
gcctatcggtggatggtaagactatttaaaatttccatgattgtgtagaggtgtttttttctttttctttttttttttaaacagtagagaaactccagtcactattgttcatatatggactcttgtaatggtggttataggtctttacaatagagctataaggaatactctagcttgtgaatttactaatgagtctcagttgaggcacaaatgaactgatggagtttaaatggtgatttttataaggccaagaattgaagcctttgtataatttgtgccatgcccttttattttacctcttgtaatccagatagctgaccagtttttactttgggtataattcccaattgtgtttcatttagtaaacaaacaagtgatgccaatactggaaaactaataatctttagtaatattgccttaatttaacagctctacattaatcatactcctccaccactgtccaagagtaaggagagagaaatggacaagaaagatttggacaagtcaagggaaagatccagagaaagagagaaaaaagatgaaaaggacaggaaagagcggaaaagggtttgtaaaattttttttaaactagtttggaaagctcattatcatgtacaccagtgtgtatgttgccttttaaaaaatactagtttgttccatagtagtctgttatttcatgattttattgatatttttaccctgaagtgtttgcattttctacgttaataaggatcttcagcctagtaatctctgtcagctctgcttgtctttcatgccattttaccaagtatgtgaaactactgcaaatactctccattgctagttagctgtgcccttctcatataaaagtaatactttaaaacaaaaacagaagcccttggtcaatgtagttcacaattcttggttctaggatcactcaaacaacgaccgtgaagtgccaccggacttaaccaagagacgtaaagaggagaatggaacaagtaggtagacttattcatatctttgaagatatcatcgaagtgaattggaaaaggctttcatgattttcttttgtaattttagtgggggtttcaaaacataaaagtgaaagtccttgtgaatctccttatccaaatgagaaagacaaggaaaaaaataagtcaaaatcttcaggcaaagaaaaaggcagtgattcatttaaatctgagaagatggataaaatctcctccggtggcaaaaaggtaaattaggaaaataaaggaataatatgctttatcttaaaaaaatcaatcctgaaaatttagcaaatattgaatttttttcctagtcctatagtcttttgttcattatttaggagtgggaagaagaggtattgagggagggcattccgtttggggaatttgagtcagttcagtcccagattaccaggagggtagagttagtatacctctgagattcctttcccctctccattccattcccacctacttctgttgattgagtttca

SEQ ID NO: 138843 - DNA, 2066 bp, Homo sapiens
tctgtcagttcaccctttacccctaatttccaaatagtgtatttctagttttgatcaattgtgttttgatgtagcaattctagcagctacttttgatgaagatagtgttaaaaaaaaaaaaacaaaaaacaggttccattaatcagcctctctctaatttaggagggcatcagtaaccacctcaagacagaatttagctttcaatttgttcaccatcttaaaatgaggatttacagccaaacccaagcctaaaagtgaggccatctttatataatatagtgaagctttaataaagtcagtggagcagagttttctgaaacagattttgaaaatcagtcaaattcttttttggaccttaatgatccgaatgtcaagaataaaagccaatcaagaacaaaacccagcgatgctacatacaaatccatttaatgaatccttaattttatttgtcaaacttgtattgagtattcactgtgtgtacaaggaactaggaagtatgtaaaagtagaaaggcaccttagctcttctaccatactggaaactgttatggacaaaaatgtatgacatgaagttaatagggagcacttgtcctaaaaaaaaggtaaatataaaataatgtaaagtgagttgcagagttgagggatggttgagtgctgttgactttggccatctttgaaggctaagtaggattttaagaagttaagataaaaatgaacaaccattctagtaatgagaactgctggaaaggacagatgttagggagcagtgatagccacagcatagaatgcattgggttactatagcaggatataattgtgaaaagatggtggagagtttggaatgcctaaactaaggggtatgcatttaattcattaggcaatgagaaactctgtttttatgcaaaagagtatttgatcagaactattctaaagaaggaattgaattgggtacattctgaactaagaatttctgattgtcagttgagctatgtgactttttatgtcaagaatgaagtatttgaacattaatgccagaagtaagttctagaaaaatttctcaattcctcacagtacagaaagtaagcacagttcaaaacttcattattaataagggttgtgtgtgtgtgtgtgtgtgtgtgtatttttttttttgcttttattgggaaaaattactacttagagaagtcttctttgagtattgcagcaatatttcctttgtcttaatcattttcataaataatgttaagatatgaataaacctcacgattagaaaaatcttgatgtcatttaaggcattctagccagcaagagtatcttttagacaagtatttttatgactatcgttctcttgctctttattaataagcattttgtctatttcagtttatcaacttttaaacattgaaattttaaagaatctacttctgcattgctatggcagtatttctgagccaactgaattgaaaatgtttggtggtgttaaaaaataagtgtttaattctcaaactgatggttttcatttttcatgtattcctttgaataccaaaggatttcttcatgtaaaaatatttgacttttgactcactattctatttgttcctaaggtgtatctagcattgtgtagttatgtaatgagttatattcagtattctgctgcataatacttttaatgtcttaaattaaacataggcttgtagcacagatataaatgccgtaaggttaggtatctgattatttcctgactacttcctaaatattttatgttacagcatatttccatatttacaactcacctaagaagggttatctctcaattatttagttagaatatccttgatgattggctgttttattgcgtatagcccttttggcagagaaagaataggcagaggagaatattggttcattattttttagtcttttgaattgtttagtcatcctcagctgactagatggctttctgaggtatttagaaccaggaagacaaatttcacagttaattgtgattattttgatagaaattggagtgctttcagaagtagagaacatgcagcctttacatttgta

SEQ ID NO: 138844 - DNA, 3244 bp, Homo sapiens
atttgtttatgatttactggataaagaaatacttccttttttcgagaaggagtcttgctctgtcacccaggctggagtgcagtggtgtgattttggctcactgcaacctctgcctcccaggttcaagtgattctcttgcctcagcctccagagtagctgggattacaggtgcccgccaccatgcgcagctaagttttttgtatttttagtagagacggggtttcaccatgttgaccaggctggtctcgaactcctgacctcaagtgatccaccctcctcagcctcccagagtgctgggattacaggcgtgagccactgcacccgaccattacttcttcctttttccttgtcttaaagttgtcctttagttttcaaaggactcccccttagttctagtatttttgaagttagtaagaaaccctttatgatatattttatcatatatcaaaggatatattttatgattatttgtgttaaaatcccatgtttttattcttaagcaacaaagctgttaaagaaaatgacaaagaaaaagggaaagagaaagaaaaagagaaaaaagaaaagactccagctactactccagaggccagggtacttggtaaagatggtaaagaaaaaccaaaggaagagcggccaaataaagatgaaaaagcaagagagaccaaggaaagaacgccgaagtctgacaaagagaaagaaaaattcaagaaggaagaaaaagctaaagatgagaaatttaagaccactgtccccaacgcagaatcaaaatcaactcaagaaagggaaagagagaaggagccatccagagaaagagatatagcaaaggaaatgaaatcaaaggaaaatgttaaaggaggagaaaaaacaccagtttctgggtccttgaaatcacctgttcccagatcagatattccagagcctgaaaggggcaagtttacctttctttatacgttcttacgttttgttattttaatgtatagttggttattgtctccttgttttggtaagttatataggggttttgctaggggaacttgtcatacaagttggtgtttttttttaagtgtttggaaaactagaaatgtaccttattctgactatttctttttgtcttaacagaacaaaaacgccgcaaaattgatactcacccttctccatcacattcctccacagtaaaggttagtatagcctgaggaaggcagcgtccatgttaggctcacctgtttggaataccagtgtcctgacttccttcaagtcttatgccaagcattcactggagccactggaggttttatattgcattagaaaatgaatttttctatattggtggactgattttttttcctattgagtatttttattataaaaatgttaaaacttcaaggacttagcactaattttgtagtgtttcaaagtgcaagagaaattttacccagaagtgcctcaactgctttaagcagtcttttttggagtgcaatggtagctacaagcaaacgaatcttttcagcagaatgaagcctatttttcagcatattgaagaatatatagcactgaagacttcctggatgacacaagataaacaagttacctctgaattcaagcttcttgatgagcatcataccgatgtgtgccttctaagaaggagtcttgaaaggagttccattttaaagtctccttggtgatcagttctcctgtagttgtgtatattcagtgagcatgcagcttctgttgtatcttcccttggaggtttgtttatacccattgggttcccaacaagttgaaccttgcgttacgataaaagcagatgtggcatccaatcctaccacccagcaaagagaaaccccaggcattcaactgcagcacaaaatcgtgggtgtagccttcttgaagactcagggtagccattccttgctccatatttaattttaattctaaagtcatctaatttcatggaatctttgaatttgcagtacgttgaacttttaaaaaactgtaagttattaattgttcatcaagagcactgtggtggaatatcgtagttgatttctttttctttctttttttttaatgctttctttgtgtgtgggaggtgtgagattcaccatgataggcactttgcagaaaaaaaaagtgattactcttatatattttgttttcttgttaatacaatgccactgaatttttcagctaggatgtgtatattcatattagagttaaaaataaagtaaaatgtgaatcctcccaattaaagaagaactatgaaaaatataaggcaatgttgttcttccacagtgacctccagtattttaaattttttgtggagaaaaaaatgttttgctttcttaaacctcttaactatagcttaagtagagagatatgaacaatgtggcattgacatttatttttaaattctgagcagagaaagatttttatttcttacattgagtacatttaatttagtttttaacattccaattccattacatgtttttttttattgttgatattcatattgataatgacatcatgaaatttatcctcacaagaagtagctggtttatttccaggttacagccatacttcccaaagttcctctgggttctgagaactatgccagctcacctgtcatctccattcattttctacaggacagtctcatcgaactcaaggaatcttcagcaaaggtttgagtcttttaaaatcatcatgcctaagtaaaccaaatgttctttacttattttatttagtagatgtcctcaccctagtacattcagtaagctgagatcagtgggataaagtactctgcttacattgaataaccttcaaaaatattaaatgttaaaactgaaacaacagatgacagtggtcccttttaatgagattgttataaaatgtgtgtaatgtggcaacatttctatcatctctccttgcttgctgtgttataccttctccttttatgctttttcaaaatctggaaataagtttaacattcggggaagaggttatttgattgttttgggtttatttaatttttcaaaacaaatctgccaggctgtctgactgtttagacaacccaaaataccaaaaaataaatttgatgcattcacatatctgttttaaaaatggaactcatctcaatctataaaaattctttatatatcctctgctgaggtacctttttggtagttacagcacaatatcaggagatactgttaatgtgaaagaatcattcccctggaca

SEQ ID NO: 138845 - DNA, 5280 bp, Homo sapiens
gggccaggagtttggtgactaggtggaggttatgattaatcaaaaattatttgagtgtccttttctactgacgactatgctagtaacttaaagtgattcatgtgactctaatagcaagagcagtagttctcaagaggagagttctttaggagaagactattgagaagccgagtcttgaaatggacaggccttgaaggtagattaggtttggaaatatggaagcagatagggaggtcaccatagggttccagcaaagacaggaagtagattgaggtttagggagaccacttttactgattcactttcatgtagtgaatgtacttagtgattcatatgaatagttatgatggggccagattatgtaggcattggaagtcagggagaaaagtagacttggtaaaattgagagctattttagattcctgagcaggatagtaatgtaaaaaatggtacttaaaaaagattactcatgacagcagtatgaaagatgctttttgactagcattaggctaaagaccagctaggtggctttttgggcagtctattgtgagagcatagactgatggaggtagtggcagtgtacaaggcttgtaaaccagtcttgatataaaggagagggaagagtcaaagatgacaccatgcctgagactaatagtgtcagtgttgcaaatgtagcctgttctgatggtgtatgaagatgccatgacagtgttatgagtgtgttgaatggagataaaagtagcacgttcaagtggacctatattcatgttaaagtagttataaactatcagcctttatctctttaaacttttcaattaaaagaagaaaggtaatgtgcatatagttagaaaagtgtctaattgaattctttgtagcccccaaataaaaagaaaaaagagaaggagcgctgtactgcccttcaggacaagcttcttgaagaagaaaagaaacagatggaacatgtacagagagttctacagagattgaaactggaaaaggacaactggcttttagcaagtaagttgttggaattgttaggttcctgatgctggtaaattacagaaaacaaaacattataactttagaggtgttaaagtgtattatgtttgtatttcaactcagtgttccctatcccattctttggttatttgttaatgcagaatcaacttcatgttcactggaggaactgatatagtttgctggtgaagttaattaacttttaactacatattggcagcttgtcattcagcttttctgtataaaacatatttctggagaaatcatagaaaaaaaggtccacatagtaaaaatgataatcatgaccaggcatgacatttggttacaaactataaatagtttgtggtttatagtattctcttcactaaaggtaatatgttgtcatgtttagtggctttgaggcacttggggaagaagtttaccacttaatatattcttcctttatttttagaatctaccaaaaatgagaccatcacaaaatttctacagctgtgtatatttcctcgatgtattttttcagcaattgatgctgtttactgtgctcgttttgttgaattggtacatcaacagaaaactccaaatttttccacacttctttgctatgatcgagtaagtttttattgcaacctttaaaaagttctcacacaaagatagctaacattataatttatagaggtattattgtgtgtttagttaaaaagcatgaactcaagaaccaagtgtctgaacttgaatcctagctctactactttctagctgtatgatctttggcaagttatttaacctctctgtgcctgttttcttatctgtaaagcataagtacctgcttcataagattgttgtgaggattaaatgaatcactacacataaaaagtacctgatatgtaataggcactcaaggttaaactattaactaagtatttgagtttacgtgttgtatcataataggtagaactctcttctccattcttaaccttcacttctcaaaaaaaaaaaaaaagacaaaaaagtttacaccttcacacacatataaaagcagggaagcttttcagtatggtcatatgcacattttgcatttagcttttttcttattactacattttgtggtttaaaaacataatgtggccgggtgcggtggctcatgcctgtaatcccagtacttcgggaggccgaggcgggtggatcacaaggtcaggagatcgagaccatcctggctaacatggtgaaaccccgtctctactaaaaaaaaaaatacaaaaaaattagccgggtgtggtggtgggtgcctgtagtcccagctactcaggaggctgaggcaggagaatggtgtgaacctgagacgcggagcttgcagtgagcctagatcacaccacggccctccagcctgggtgacagagtaagactcagtctcaaaacaaaacaaaacaaaacaaaaaacataatgtatgttccagtatgtcagctgcatatttttaatttctatcagcatttcctctgcttactctccccgtaaacccagtaatatgtatggctaagtggttaagaaactattatgtaataaaaaaaaaacaacttattatgtaataataatgataaatttttttttccttgtcactgtaaatcagctttctttataaaagttcttgttttgggtggttgttttatgaatgcattatttccccacaaaagccaaaatctccaaagttctctgcagtgtcattatataaagggaatatacattttgactaggcttacctgtttattatgacttgctgtaagagaatcttctaatatttttaactgattttgaccttgatttgtttatattttttaaacatttttctcctgtaggttttctctgacataatttacacagttgcaagctgtactgaaaatgaagccagtcgatacggaaggtttctttgctgcatgttagagactgtgaccaggtggcatagtgatagagccacatatgaaaaggtatgactaataaaaacccttatattttacccatgtatataatgaccacatccattaatatctagatagttgagttttaaaagagaagctgagtttaagattcagttgtaaaactgtgtttataagcacaattaatttgttattaaaatgtgctatgtacttttttattctatctcaaactgacattccaaattagtatctttgtataagttgaactttttgtgactacctatccaaatacgcatgatgtttttacacggaaacattgatctagtctacttaagtttcaatttctgctattttgtggatcataatttttctttaaaagtgacaaacattgtttccttaggaatgtggaaactatccaggattccttaccatattacgggcaactggatttgatggtggaaataaggctgatcaattagactatgaaaattttcgacatgttgtacataaatggcattacaaactaaccaaggtaaaaaaaaaattggatttttcaaaggcaaatttttctctgtatacttgtgcttttataataatggatctgaaaatgtttgttgtaggcatcggtacattgccttgaaacaggcgaatatactcacatcaggaatatcttgattgtgctaacaaaaatacttccttggtacccaaaagttttgaatctgggtcaagctttggaaagaagagtacacaaaatctgccaagaagaaaaagagaagaggccagatctatatgcattggctatggggtaacaaaattatattttaatgtgatttacaagactagatgacagaaggattctgaagactttaaaatgttttacagtgttgaagtttatcttctgccttcaggagattatgggagattatgcgatcatgtttccacaggctggtgagagttaccacttctgattatcaacttccggtctatactggatgatagtttttttaaagtcatgtataatatttcttgattgggaggaaatataattttatcatcatagttaacagatcttcaagagtaaaaaaaaaaagccatcttagtttaaggattagtttatagtgaaattgtaatttttaagaaagctgggcgttctataaaaaccttcaagaacttattaaaaattggtattttttaattctctagaaccacatagtagaatgaataacttgctaattttattcttaaaaacctcatgtttatgttttttgatttgtgtttgtatatttaaacactttgtgcgactttcagctactctgggcagttgaaaagtagaaagtcatacatgatacctgaaaatgagtttcatcacaaagacccccctccgaggaatgcagttgccagtgtgcaaaatgggcctggtggtgggccttcttcatcatcaataggaagtgcatctaaatcggatgaaagcagtactgaggagactggtatgcttatttgtagaaacttataagtaatatattttatttcaacaaagtgaaatgttttgtatcacagaacgagtacaatgctggcttagtattactttttattccctagataggagtatataagcgttaagaagtaatcagcttgctgtttctttctaattattctctaatcattttgctctgaaattgtagcttatttacatttaggggcttgttaaataaaaccttacttttatttcagataaatcaagggagagatctcagtgtggtgtgaaagctgttaataaagcttctagtaccacacctaaagggaattcaagcaatggaaatagtggctctaacaggtaggaacactgtgccatgtgtcataattctaaattctttttaaaaatgatttttatgtatttttttgagacggggttggtcttgcaatgttgcccaggctggtctcgaacttctggcctcaagcgatccacctgccttggctttccacactgctggaattagaggcatgagccactgcacctggccctcataattctaaattcttctatgagtcctcatgagtagaaggggagtggttgttgagtaatgtgaaaagtcatttatgttgggctttgaaattttgtatgtaccctattttgctgatacgctttacatcctaattatgttttgtatagttatgcttgtataacgactttgtttctccttctgggatattcaggggaatgtaggtgtgaagttaaacaaatattttaggatagagggattgctgtgggttgaagcgattcttgtgcttcagcctccctagtagctgggattacaagcgtgtgccaccactccc

SEQ ID NO: 138846 - DNA, 1048 bp, Homo sapiens
gtggtccaccttgagacacaggtctgaaagataggcttttaacctagttcatattctagatcttgcccagaacaggtaattaggctgtcttttatgcagataatgtcagccctattttatcccgttttgttagaaccttagcagaagtcattctgctcatctagattcatattagttaccttcaataagacctgtcctctaaattaaaaaacactctctgttttcccaactgctattccctcaggtttctgatgcaattgggactcctttttcgtaactaatgttctttgtagctttgtcacttacgtggtctcagtggttgtcagcatgctctctaaaatggggataacagagcataaatcttcccacttctagaacaattgtaaaattctagaacaattgtaaaattgagcactcaggaaggaaggcaggtaactgagctgtaaggagctgagactcttttgcctatcacagtgtagaactggaagcagaacctttgatcatctcgttttgggttacgtgtttagcacaaatagaatgatttaagtgattttctaacgtaaggaagtaactagttttaggacttcctttaggttcgtatgaagggtgatacctaacttaaacaaaattttctggatgagagctctttcatcctaaagagactgaaggatgtgaaacaatagcagcaactctgtgttatcttcatatatatgtgtgtgtgtgtgtgtgtgtgtgtgtgtgtgtgtgtgtgttcatgtataatatatatgttcatatatatgttatcttcatatatatagaatatatagaaaaaatatatatatttttgtgtgtgtatatatatgtataatatatttggcatacacatctctgcagcccctcccattgtactaacaattttttttcctcatacaattaagaatatggcattcctctgttttttcccccaaattaggataaaccagtcaaacgaaagaagctgcagcatcagttctcacatgctttaaacttcaatataccacagcttttcacagaaaaatttatttgg

SEQ ID NO: 138847 - DNA, 2097 bp, Homo sapiens
tagctctcttaggaaattcagtcttagaaattttaggggtagaaggccatgatgtaaataattttccctcaaatgattaaaaaattgagtgtgtgactatgtatgtagagaggggctccagagagggagagaaaatgcaaataatcaagcaggagtaaaaatgttaccaggtgaagttgaggtaaaggatatatgggtgagctttgtactattgttatttttccatcctatctgtaaatttgcaattatttccaagtaaaagttaaaataaacttacgcaccaagtatttgtcaatatagttctaggaatgcagttaaaaactgcttcagccccttcccccatatttatatacaaataattaagggtttctcagtatattaattacaatacattgttacttttatatttgaagttctaactatagactgtttcttttttctttttgaatagttttgacctgcttatattgaaagaagtggtacaaaaaatggcaggaatagaaattacagaggaaatgacaatggagcaactagaggctatgactggtggagagcagctaaaagctgaggtaagaattgctatttttgttcatcaacttttaaaattcataatgtatgcacggtcatagtaaagaatccaaacaatatgtaagtttataaaaccaaatgtcaaagccatacataccttcctttcacaaccacccctgccccccttttgaaattgagatacagtaattactttaactttttaaaaaagctgaaacaaagtataaaaggcagtaagtaatgcatccgtaaggaaaataattaccaaataaggccgggcgtggtggctcacgcttataatcccaacattttgggaggctgaggtgggtggatcacctgaggtcaggagttcgagaccaacctggccaacatggcaaaaccctgcctctactaaaaatacaaaaaattagccaggtgtagtggtgggtgcctgtaatcccagctacttgggaggctgaggcaggagaattgcttgaacccaggaggcggaggttgcagtgagccaagatctcgccatcgtactccattctgggcaagacagtgagatgctgtctcaaaaaataaataataaataaataaataaaataatcaccaaataattactatatcttctatgatccttgatatcctcactcccttaagtcttagttgctctgttgaatctgtgccatactgaataatgaataatcctttatgaggggactgcaaggtggaaaatggaaaatatgcagaaatttaaattcagttgacatttgtctttaagccagtgactgtagtcagtaatagtcactgaaataaatttgtgtaagggaaggaatgtggaatgtaggagttttttatattaagcattttaactcaacttttttctgtgtctttttcaaattagcatgggttatgtactgtacactggtaaatttgtgtcttcccttgtgcagggtggttattttggtcagatcagaaacactaaaaaatcctctcagagattaaaggatgctctattggaccatgatcttgcccttcctctctgtctgcttatggctcagcagagaaatggggtaatctttcaggaaggtggagagaaacatttgaaacttgtgggaaagctctatgaccaggcaagttaaagtggcttttatgtttatgtacatgtttttaatcctgttaaaggaggataatgtgttataatttgaaaaatgtcatttttgcacatcatttgaatatgagacatcctaatgtgaaagacattctggaaatagggcctatttctatgtaaattgtgatatataagagatagctccaagagatgttatatgtaaggctgtcaattaattaaatattacatcattaaattcctgcaacttcaagttgtttgcatttatatctttcccgatctctggaaatctcagtcataacagaatagatgcttgcttgcccacttgtgcatgctcactctcttttccctttttttttttttttttttttttttgagacaaagcctcactctgttacccaggctagagtgcagtgcatgatctcagctcactgtagcct

SEQ ID NO: 138848 - DNA, 2092 bp, Homo sapiens
cccatttacaatagccacaaaaaaagtaccaagagatacatctaaccaaggaggtgaaagatttctactagaactataaaacactgttgaaagaaatcatagatgatacaagcaaatggaaagacattccatgctcttggataggaagaatcaatgtagttaaaatgtccataccgcccaaaggaatctacagattcattgcagttccagtcagattaccactgtcattttttatagaattggaattattttctaactgaaaaatgtagcctaagaaaatattctctaaggcagtgataaaatagtaatttctatataaatatgaaatatttatatagaaaccactttgttaaatatttatataggaaaccactttaattataagcattatttcttttgaaaaatagaaagtgtagccattacttagttggcacagtagaaatcctttgatcagttaatgccttctattgtttgttgctgttttccagatcttgtcacaaatacagaagtatgataacttaataacacctgtagtagattcattgaaatacctcacttcactgaattatgatgtcttggcctgtatcctttcaagtgaagtaatatgtagatttcatatttaatagatcatatggtaaacgttttattttcattctattttcctttagtaaccatctgaggttgattcaggtggctgatctgaagtttggtcagtcaattgtgtgtgtgtgtgtgtgtgtgtgtgtatgtgagagagagagagagtgtgtgtgtgtgtgtgtgtgtgtacgtgtgtgtctttgtgttgtataaagggagacatgttaggcttaccaactttttttttttgtgtgtgtgagacagacttttgctctgtctcccaggctggaatgcagtggcactgtctcggctcattgcaacctccgcctcctgggttcaagcgagtctcttgcctcagcttcccaagtagctgggattataggcgtgtgctaccacacctggctaatttccttgtttttagtagaggtgggatttcactaggttggccagggtgatcttgaattcctgacctcaagtgatccacccaccttggcctcccaaagtgctgggattacaggcatgagccactgcacccagttggcttaccaaacatcttgatattgatggaatctgtcttgattgctgaaagatggaaagtaggctaaagaagaaatgttggtactacagtaagtgtatttttcaataattagttttagcaacatccctggtcttggaaaactagaaaaataatttgtaatgaccaacaattttgcccctatgatgtggcatattcatgttttaagggtctttattagagatgtaatgacttagttttttcttaatgtatgaaagattgtatcattgaagctttagctaatccagaaaaggaaagaatgaaacatgatgacacaaccatctcaagctggcttcagagtaagtatttttatttttccaaagatgaaattactatctgtggtaactgccatgttatgcattttattaccgatgcttagagacttttagaagcctatttgttaagagttgctgagaatatctagctactgagtttgttctgcagagcccttggctatgtaaggaggttgatatggtacttatttattttcctaacttaagagaccattattgactgtgatagaatttgggtaagcattactggggaggtgaaatctccttctttttattttatttttttttcgagatggagtctcactctgtcatccaggctggagtgcagtggtgtgatctcgactcactgcagcctccgcctcccaggttctagcaattctcctgcctcagcctcccgagtagctgggattacaggcacgcgccaccacgcccagctaatttttgtattttcgttagaggcagggtttcaccatgttggccaggctggtcttgaactcctgacctcaagtgatccgcccacctcggctcccaaagtgctgggattacaggcatgaaccaccatgcctagccaaaaatctcctttttaactaacattattttataggagttgatcgtaagggatcta

SEQ ID NO: 138849 - DNA, 5083 bp, Homo sapiens
acattttttcccctgatgttgaaaaaggaagagagataaaagttcctcattcctttgctacccctttcctttcctcaccccattttatgtcttcgatggagaaacataaataagctttgtgaaaagggtgggtgaggaatgggatattgtgtgttatgttattaagaaatggtaattttcccaaggctgttataaatttattgttggttatattaatatagacctcttactgaaataacttttccttctttcttttaggaagttatccttagctgtttgcttagcattactgaccaggtactacttccatctctttctttgatggactgcaatgcttgtatgtctgaggaactatggggaatgtttaaaacatttccatatcagcataggtaaatacatattattttcatgtttttaactattagtaattctagtatattaacctctaagtgtttaacttttcctaattcttcatctcatcgttttttaagatatcgtctgtatggccagtggaagaatgaaacttataacagtcacccacttttagtaaaagttaaagctcaaacaatagacagagccaaatatatcatgaagtaagttttaatttatttttcatattaatctaaattatatctgaatctaatatactttctttcaggtagcttgtctgagcctcagttttgggaaagcctatgtgttgtgaatggtatagctgatttatatactacagatggaatgactgttaactgtggttttagctcattttgactaccaagttaatgttttcatagttgttgtgtttacatatggataaaaatctaatggaaatcctctttaatatgtgcatcatattatgggatgaaggttttgttttttctttttaaggacagcctgctgtggcctttgcttacctttagtgatttgtgcaaggtagtaaaagttctagcaatttccactgctgaaagttaccataatgaatttttttaatctgttaggaagaactaatgaaattatccagaactatctccatagggagtcaacttttgagaaatttcttttttaaaaaaatttgtacacttttattttcatatcattaaaaacataagagtgatgttctacttcccagtagattatttgaagtttaattatgaaaatcatgtacttcagattagtattagtttagatgcttaattgtattgctgtattgcaagtgttttcaacgaggctattgtcagttgtcattccttttttaaattcatggcagtggtatggttattctaattaaaagtagttcgttctcagtttatttagatttaacagtgtgtaatgtctgttaaatgttgtccttgcccagtgatattgtttctggtcacagcctattgggaaaacaggtgtgtgcatgatcacaatctagttgttgtttttttttttttttcctgtgagcctatggattatattgaaacaacctagtataataggtgctgttatacagtatgaataaagtgctatgggaggatagatgagactaaatgatttcacttgggggagttttgtttggcaggagttgatattagatctgaaagagtttctggacttaagagttctccaggtacagtttctagcttaacaacagcagctaatatttagggagctattactgtatgtgccaggcattaaactaagtgctctgcatggattgtttaataatacattaagcatttttaaataccttgaattcatccactgtcactaccactactaccttagttattttatctggtgtattatagttgtatattctcttacctaaaaatcctttggtgactgactttacctgaaggtatatgttaagctttatggcatggtgatataaataagaggtcctccctggtttgtccctccctgcatccaacctcctttcctgccaattctacttccagatgtactgagcctacttatgtcccctaaatgtaccactctctccttagcttctcttcccctgtatatactttttgttccctctgtttgtacaggttttcccttaccttcctttccccctttccatctggtgacctcattcttggagagtgagctccagtgttacttctagtgaaggcttccctagcataaactgccagacacaatcaatctttatttccatcactattctttagcatataatgttatcatacctctaggtaccttgctatgattgttttttgaatagtttatgtgtttacatgatttaagtttcagtaaatataaaaggtataaatacagcaaaaagtctcactccatcctccatctactcagttcttcccctcaaggaaaagtaaccactgtttagtctcttatttatccttccatatattcttatgtatatgcaagccaatacaatatatattatccccctcttatattattattatattaatattgtttttctttgtaaaaatgggacctcactatgttgcccaggctggtcttgaactcctggcctcaagtgatcctcccaccttgacctcccagcgctggagttacagacgtgagctaccacaccccagccaccttttatattatcaatagcatataagtactgttctgttgattgctcttttttagaatattgaaatttaataaatgaatttaaatctgtctccttcactggaccaggcttgagagcaggaactgttactctgttattcatccttgtatttcttatttttttttttttttttgggagatggagttttgcaccgttgcccgggctggagtgctgcagtggcacgatcttggctcactgcaacctccgcctcctgtgttcaagcgattatcctgcctcagcctcccaagtagttgggattacaggcgcctgccaccaagtccagctaattctttgtatttttagtagagacggggtttcaccatgttggccaggctggtctcgaactcctgaccttgtgattcacccgccttggcctcccaaagtggtgggattacaggcgtgagccactgcacgcggcttcatccttatatttctacactgaccttagctaaaaggctgagacacaatcttccttgtatttctaatgcttagtactttgactgtcatcgtaggcattaatatgaatgaatgaataaaaatacaatttactacagaatagtatgtgcagaatttttaatatacttggatttttgttatatttgtaagctataactattttaccaggcttaaacaatatgattttgttactgtttgaagtttttacattgagcatataatgtattaacttattacttgtagaatttcatgagttttgaatactatttaaaacatgagcttgctatagggcatttagtaattctttctacaaatgtttattatgttccatatgctagacactggtagtttgaggggaagacaaagacaagaaaatatttctttaatttttgtttgtttgtccctccagggtgatggaggcagaagggaatggaatgaaaaacagagaaaggaggggttggccttggcaagtagagggaggcacctgaaatattggggttagaaatagggacaggtagtggtaagttggaaatttgaacaaaatactgtatagctaacttttaaaactaatggtctctcttttctatgaaaccaaaactgggatatggagaattggaaagggaagcagttgatgaaacagttttgattgatggggccagttttgtcatgagaaattaattaaagcaagttcgtcacttggagaatggtcacatctcctgaattataaactgaattcataatttacttcattatattttcatcctagaaagcttccttcctgtcacttgtagccttttgaagtctctagatttattatgtaatcatctcaggagaggcatttaagattctgtgtaataattgttttgaactgtaagaattcatagataaaatttgcagaatgctggcaaaaggataatgagcaaaggaagaaataaagaggaaggaaaggagtagaatttagtttcaaaatattgtttaccttgaatatgaaaagcagataactttacatattgagggagtaaagttacataagtttacagataacacagtaactctgttagagtcactgagacagatggcacgagacatttcattgcatgacaccaaatttgatatcttaatccctaaactgatgagtcctcctaaatctgaaataattttgattctttgtaagaagagttttatgtacttgtagagtacattaagagttttactgattattagactattactataaagtggaaatgtgtattttataaatgttaagcatttaatataaaatgttaatatcctctgagagaatccctaaccaaaatagcccaaatcctaccataaaggatgtgatgaatgtagttgtttacatgaatccattttggatatttggggaataattgctttttcccccacgatgatgtaacaaagctatcaacattacaaggaatgttacttaagatgatccgtgccacctttttcttcctccgtaggcgcctaaccaaggaaaatgtgaagccttctggaagacaaattgggaagttgagccacagcaatccaaccattttgtttgattatgtatgttttgaggttaatattattttaagggatttttctttctgttgcctttaaatcagtgcaagtggaaatagaatgatgttagaaaatgaaacattgtaaggttatgctaaaaacaaaattactacacaatatatttaacacattgatctattttaatagtaatatgtaacagtgctactattacaggcaatataatagttattttgtatatataatgttattttgtataccacatcttgatttctggtattacttgattttagacttttagaaacattcaaataacatttcattgtgatttatatgtaatactatcactgcaatatttatttatttatttatttttttgagatgaagtcttgctctattgcccaggctggagtgcagtgacccgatcttggctcaccgcaacctctgcctcccgggttcaagcgattctcctgcctcagc

SEQ ID NO: 138850 - DNA, 1081 bp, Homo sapiens
ttgtgcacatgtaccctagaacttgaagtataaaaaaaaaaaaacagaatagtacctgcaacctagagtctttctcatgctgcattctagttactatcctaaccataaccatttatgctttttttttttaaaaaaatcagctttgaggtataatttaaatacagtaaacttctacaattttatgagttttgacaaatgcatacagttgtatgttcaccaccacaatcatgatatagaagttccctccttccattgctgttcctggcaacctctgataggctttccatcactatagttttgctttttctacatcttatttaataaatggaatcatatggtatatactcttttcagtctagtttcttccacttaagcttttgagatttatccaagttgcatgtgtcagtagttcctttattgctgagtgatattttattacatagacgtaccagagtgtagccaccagttgatgggcgtttgggttgtttctacctggaggctattataaagctgctttcaatattcctgcacaagccttttgggaggcatgtgtttttgtgtccccaggggtgggattgatgggtcatatgagtaagtatatgtttaatttcataagaaattgccaaactgttccaaagcatctgtaccattttgcattcctaacagctattgtatgagacttctaattgttccacattcccaccaacacttgttgttgtcactcttttaagttttagtcattctagtgggtatgtagtggtatctcactgagcttttaattttgttccagtgactagggatgttgatcatcttttcatgtgcttatttgccatttatagttatctttagtgaaatgtctgttcatgtctcttgcacatttttaagttgcgttatttgtctttttattattgagttgtaagagttctttattctggatgcaaggccttatcagatatgtgatactgtgaaatttttttcttagtctgatttgccttttcattttgttaactatcttttgacagcaaaaaattttaacgtttaattctgatttagtagtattttttttttttttttttttttg

SEQ ID NO: 138851 - DNA, 1746 bp, Homo sapiens
tgttatatccatatttttctgtttcatcttccagtgcatcttaggtccatcccttgttgcccattcccatatccaagttcccgataccggccaagtttaaaaacagattcagatggtgtgtgttaaatgttccttgaaatccacacttctctgattaagcagttaatttggaacattctcctctgagctctgattttttttttctaatgactgttgtttttatgtgtttctaccagttgagaattatctggtgtaataaagttaggcacaattgaaatgtagaaagcaaatatgagcaagaaaaaatttcactgattaagataactttgttaaaatggtagatattgtagtgtgtgtgtatatagttatatttattatatacttatttatttgtttatttatttattttactttttaaaatagagttggagttcctaaaggtgctaaaggctcacctgttaatgctttgcaaaacaagagagcaccaaaacaagctgagagctttgaagatttgaggagagacgtgttcaatatgttctgttaccttggtcctcacctttctcacgatcccattttatttgcaaaagtggtgcgcataggcaagtcatttatgaaggaggtaagtaagatttttcttacaaacctaaattttgaaatgaaaatattctgagtatacttgtgttatgagtatctttagaaataaaaatatgaacctcatttaataaagggttatgttgagtgaggtttgtggaaaattccagtgtgtcctaaccatatgcagtcaagtgttgcttaatgacaggtgagaaatgcatcattaggtgattcgtcattgtgcaaacatcagagagtgtacttatacaagcctagatggtatgacctactacatacctagactatatggtatggcccgttactcctaggctacaaacctgtacagaatgttcccgtactgaatactgtggggagttgtaatacactgttaaatatttgtgtatctgaacatatctaaacatttaaaaggtaataccttgcactaagatgttaggacagccatgatatcactaggcaataggaattttttagctctaatataatgttatatgaccctggtcatatatgtggtccatcaaccgaaacattgttaaatggtgcataactgtatatattaatataaacccaaatctagcgagattattagtcaagtccctcacatgggaaaatatacttcagacaagtggctgcttttttaattcccttatgattagtggttacttagcattcttttccttctagtcattttcttgagtgtagttttcaatcattgctgctatgtgtaagaagtcttttcagcctcagactgttaaggacccattcttttatttatttattcttttactaagatttttattgaaataaaacatacatacggaaaaatacagctcagtgactttccctaaactaagcacccatatgtccactacccaactcaaatagtttacagtcccaccaacagtgtgaaagtgttcctatttctccacctcctctccagcacctgttgttttctgactttttaatgatcgccattctaactggtgtgagatggtatctcattgtggttttgatttgcgtttctctgatggccagtgttgagcattttttcatgtgtctgttggctgcataaatgtcttcttttgagaagtgtctgttcatatccttcgcccacttgttgatggggttgtttgt

SEQ ID NO: 138852 - DNA, 1837 bp, Homo sapiens
ctctactaaaagtacaaaatcaccctggggtggtggcacatgcctgtaatcccagctactcgagaggctgaggcagaattgcttgaagccgggaggcagagattgcggtgggccgagatcgtgccatttcactccagcctgggcaacgagagcaaaactgtctcaaaaaaaaaaaaaaagtaaaaaataaaacaagaggacctgtgccaggtgtataagtacagcaatacaaatgtgtttgattgccaggggagaacatacagaatgagaaaaagtcttgcttacttccttgcaccagtccatagtgacttttctctctccctccctcctttttttttttttgataaatggaatgaaatctataatgtttaatagttcattattattttcatttactgtttacattaaacctagttaatggaatagattatgcatttctaggggtcaggaacactccttttatagcttatcatagtgactagcagaaactactgagtaatttgttgcctaaagttttctttgtgttagggttattttataaatgtcttcattaatcatcttccactcatacaaggtgactgtttgagatacttgagcctttttcataatggagggttgactatgcacatagtactttttcttttgcaataaattagtaactagcttgtgacttaaataagctcctagaaaaagtgagatgtcaagttactaataatttttctacttgaaatttttcatttagatgatttaaatttatccctttgtgttattcagtagttcacctttcccaaattggatccatattgcaatgctttatttaatttggagtttagcctttaatggggaaatttgtaatgtttttaatggaactgctatatattttcttgggtaaactaataaattcaacggaaaacatcactgttgtggtattacattactttagggactctgtcagacagaagatgtgaaactttgagctgcgacttgattttaaaaggggtacagaattcaggtacttcattctgtcaaattataagaaaataactgaaatttacttagaaggcaaatggtcacgaataagttagacttcttatttatagttttatcaattgagaatagtgtttcctttttatatgaacaagtagttggtattagctattttatgaaattttaatgtaccatttttagcttcttccggctgataattgcattatggatgaacacaaacgagaaattgcggaagctaagcaaattgttagaaagcttacgatggttgtgttgtcttctgaaaaaatggatgagcgagagaaagaaaaggaaaaagaagaggagaaagtagagaaagtatgtaattcattctagtaaaattaacactatcttctggattttgaattatgaaatttaacttctaaatagtcatttatggaagaataatttcttagttttcattttgctgaaacctcattttctggatcatttgctacagtggttttatttttaatctgaatggctcctttttaagagaagctgtcatattttttttcttgtataaatttcaaaatgttttctaagtaaaatcacaagttgtattgactttaattgtcctctgtgtattagtggccctcaaatcctaaagagattctcagagatgatgaattctggtttcctgtggcacgacataacatgaagtagaacttaattccaagtctataaactgtaatgcctgtgtctgtttttttttttaataaatttattattatttttgagacagggtctcactctttcacccgggctggagtgcagtggcatgattacagctcattgcagccttctacct

SEQ ID NO: 138853 - DNA, 1560 bp, Homo sapiens
accccatctctactaaaaaaaaaaaaaagctgggtgtggtggcatatacctgtagttccagctactcaggaggctgaggtgggaggatcgcttgagcctgagaggtcaggactgcagtgagccatgaccatgccactgcactccagactgggtgacagagtgagaccctgtctcaaaaaaaaccctccaaaaccaaaaaacacacaaaaaaacagaaaagaaaacacacatataaacagaactgcagactaaatcttgtgcattataaaatctcacttatgctattcagctgtgagattttatttaaatgttaacctgcattgtaaattgtgtccgtttttgaaattgctttccttgtgttcttcagaagatgttccaatgtgaaaagggatgttggcataataatccttgtactgaattcagatatttggtaagataaggaagagcagtgaagcattttcttggcctagagtatttgatctaattgttcttagttattggtaggtgaaggatattgctttaattgtcctttctgcactaaatggaaacttttttttttatatttctaggaaccaaatggcgagacaccatcatctttatacagagttgcagcagtacttctacaatttaatcttattgatttagatgatctttatgtacatgtaagtcaagtgggctgctaagaatacttgattgtctgtcccaagggtagggaagaggagtaggtagccacatagcacccccaggattgggttggttcgaggttctcaagtctcactctttgaagccccaatacattgttgatttgtgtttactttataaagtgaataaatttagttatttggcagtctatgaaaattaaatacctttttggtcacctttatggagtttaagttttggtcacctttatggagtttaagtttggatatgaagttcaagttcttaactgtcatcaaggcatagctcatggggagagaggccaagttctaaccaatgtggttttttaagcctttttattatctacaaatgatgggaaatataaagttacctatatactgcttctttctctctaaaatgttaattttaggcattcaggatgaatggggaacttcattagtgtatttttatatttagtatatttaaaaaatatttttcttgtgttattcgtgtgcactaaatgactattatgcttttattgctggacccaggatgtagaagagttcatgattgtggcagatgacctctagtttaacaaaaatttagtcatcagtttcagaatctaggctaatagtatataaattcctcttctattaggttttgtattaggatatctattaatttaaaacaagtatgtccaaaggtgatatcatcttcactgcctttgagatcactttattaacatcattgcctatttttgtatactgtggctacagagttgagtaaaacttggtctttaccttggaagcagtcatactctaggaagggagaaaaaaattttgcattatttaataggtactctattggagatattcacaaagctcagaatagatagtgaccata

SEQ ID NO: 138854 - DNA, 1062 bp, Homo sapiens
aaaaattatgaaaaggaaccaaacaaattctggagttgaaaagtacaataactgaaataagaaattcactgtagaggttcaacagtagaattgagcaggtagaagaagccaagccaaagaaagaacactggttaaagtaactctaggtaaaatataaaagccagtactattacatttgtggtttgtaagtcctctttttttcctatatgacttaaaagacaaatacataataattatgaatctttaaaaagataatttcaacttttattttagactcggggtacatgtgcaggtttgttacctgggtatattgtgtgatgctgaggtttggggtacaattcatcccatcacccaggttataaatctgtcaaatggcacactataaaaatgtaatttgtgactaacaataggtggggaggggcagggatgtataggtgcagaggttttgtacactattgaagtgaagttggtattaattcaaactaggttgttttaagtttaaaatgttaattattatacccaaaggaaccactaagaaaataattaaaaactaaacagaaaaaagaaggggatcaaaatggtgcacacacacaaaatcaaacaaaaaaggcagtgatagaggaaatgaggaacaaaaatatgacagaaaacaggtagcaaaatgatagaagttcatccttatctataattattttgaatgtaaatggattaaacccaccaattaaaaggcaagagtttggcagaatgtataaaaaatcatgatccagttacatactgtgtataaggaactcactttggatttagagatacaaatagcttgaaactgaaagtatggaaacatattctgtgcaagcattatgctggagagacctggggtggctatgctaatatcaaagtagactttaagacaataagttgttacaagagacaatgaaaaacattatataatataaaatggataacccattgagaagatataacagttataaacatacctgtaccaaacaacagagccccagagtatttgaagcaaacattggcagacttgaaggaaacatagtt

SEQ ID NO: 138855 - DNA, 1885 bp, Homo sapiens
ggtatattttatagttctgtagtatatgtaagataaaataaaaatgatttttaaaatgatggtccacttttgtgaacccggacttttaactgtttatcagcattccaaatacttctgcctaaaacattaaaaaaaaaccccttttgttgcttaatttgtaaaatgcattgtttgattttcgtgtttttccaagaattaataatgtggacctgtttcactagcccgagtaatcaagaactgatgaggcaaagtgtggcatagaggaatgtttatttgactggtatcactggtcctggactatactgacccagctctgtcattaacccgttctgtgattctgggaaagtcacattctcatctgtaaaaatgtgtagtggatttatttccctctgggagagaggaagcaaatttgtaaagaaagttgtttttaaaaacatttttatcttgctatatgagttattcctgaaaattaatggcttcactagaaatgatgtataatcatttttaaatttttgtatgtctcatctgttgcaggatgctttaatctggatcccaatagagttttggatgtcattttagaagtgtttgaatgcaggccagaacacgatgacttctttatatctttgttagaatcttacatgagtatgtgtgaaccgcaaacactgtgtcatattcttgggttcaaattcaagttttaccaggtaaagaaaaacgtgtatgtatgtatatttagagattgatttcttaatcttgtttatataatttaatttgttttatttgtaaatgattggtctcatctcaggtgttctagcagaagagatagataaatggatagctaacaatgcaatgtgataagtactatattggtagtatgaatgatgtgatgtgaaagcctagaggaaagaattattaagttttgccttgggagaggtggagtcagggaagactttatagatgtgtctttttttaaacctggtccttgaaggatgaataggagttcattaaggttttctctgcatgagtaacgaacaatgtgagaatcaagatgtggcagtgtgaatatatagagatagaaggaatggttcatagtctgatgtggctgggttgtaagatgggaaaagaagggacaggaaatgaaattgggaaggtatgtgtacttcagattgtcacaggctttgaatactgtgttaagagttagaatcttatttttatttatttattttttattttgagatgggatctcacccagactagtctcagactcctggtccgaagtgaacctcccacctcagcctcccaagtagctgggactacagtcgtgtgccactgtgcttggatcacgaattttgttttataaacaatggctattggaattttttagggatgtgaataaatattcaaggcacatcttacatcattcccttaagccactaaaatagcggtcaagctaatctgtgtctctgattatttctacttcaatccatctttcatattattgttattgttgctttcttaaagagacctaactgaggcacttcactggtcaaaaacctttacttctaggatgaaattcaaacttctaaatgtggcagaaatagcacttcacaatttggcactgttctttccggccttatctttatagttatttttttcttaaatctaatattctagtcatattaagtgactagccatttcttgaacttagatatagatattgctatgaacctttgttcctgtagttccttataactaagaaaccattcttacccaaccctctcacttctcctttcttcatcttgtgaactcctatttattctttaagagcaaatgctgcttgttctgtaaaggcttagctgactctttacccatgcagaattagtcactt

SEQ ID NO: 138856 - DNA, 1055 bp, Homo sapiens
tgtattttttgtagagatggggttttgccatgttgccctggcaggtctcgaactcctgagctcaagctatctacctgccttggcctcctaaattgctgggattacaggcgtgagccaccatgcctggccttgttactgttttttagatcatacttttattttgttattcattggttcttgctttgagatgtgcagtttttttgcaaatagtgtttcttagaaatagtctagcatagatttttattagcttctaaagaaactctttctacattgtagatcatttcattttgttaaaaacatgattttctttgtctcctaaggtccattctctcaggaacttgatgattgaggctataattccgttttcttgcctgaaatttataggctggacatctctcctagttatgtctgcaatattatcttggtcttttattttcctgttaagatctcaatttggcctaatttctacaacagtcattgtcagtttgatcatatttcttgcccctagttggtgtcactgtaacataactggttattttttctatctttggggaaactccagttgctttttcctgcatttcttcaaagatgtatcattcaaaaggtgtgaactcttctcaagggtagcgtaaacattttattaatcgctatagtttttcagctttattcaggcttcattgacatatagtagaatgcttatatttaaagtgtacaatttgacttttaatatatgtatacatctgtgaaaataccacaaacaagataatgcacattcctcccactacccctgaaattttctcttgcctctttgtgtttatcctccctctcttctctcttctgttttcccggagaatcacaagcacctggcacatagtgggtagttatttaatacttatttaaatgaaggagggcatctatggccattgtagatctgcagtttctttatttttccacttattctctttaaatatggtttcttgtttgttcctcaaaaggcataaaggcatatgtgtgtgtgtttgtgtgtgtgtgtgtatgtatgtatatgtaaaaat

SEQ ID NO: 138857 - DNA, 1031 bp, Homo sapiens
gtatactacttacttttcttgaactttactctcagggagaacaggctatgatcctgtttctgaagaacagtgtaacaggcacaactgcaagctcatgaggtatatggacagtctatgagtataaacaatttgatttattgggctaaacctatattttaacccaccaagtagcagtcaaatgtcaccttcttagtgaagccttccctgcccacccctgtcaaaactccctgctattccctgattatttttctttttttgcacatatcaccatataatatgctctgtacctcctccccctccacctgtgatgtaggctctgtgaggactggggttttgtttggtaccttatccttaatacttggtatgtaggtgataaataaatactgggtaaaaaaggaatgaatatttcctctattcttgtataatctatactgactcttagcatttttttcctgatatggagaattttagaaagttcatcttcctgtctcagtgtttatttatctctgactaggtgatttcctcctcccccaattgtctgagaaatgaacttttatttttttgagacagagtcttgctttgttgcccaggctagagtgcagtggtacaatcttggctatccgcaacctctgcctcccaggttcaaacgattctcgtgcctcagcctcccgagtagctgggattacaggcgtgcaccaccatgcccagctatttttttgtgtgtgtgtttttagtagagttggggtttcaccaagttggctgggctggtctcgaactcctggcctcaagtgatccacctgcctcagcctcccaaagtgttgggattacaggcgtgagcccccggacacggcctgaatgaaacttttcattgatgtgaaaatagaggttgaaacttcaattccaatgagtattctttcagtgttgttagcatttattggagtccctcttagtgcagacttcatccaggccttgtctcattctgtccagaacacctcactgaccagcatcctatttttcatggcctctttgga

SEQ ID NO: 138858 - DNA, 2576 bp, Homo sapiens
aaaagcaagagagactattttacacagttggtattagcatgtttggtaagtttttaaaaatatttttcccttttaaaaatctgcattaaacagttgtaatagaagttaatcatgttaatgaaggaggatattgacattcagttgacttttctcataaggtgagatttgggttttgaaatggaatgttttgtgaaataagacatgctgtttctgtgaaataagcatgtaaccatatccatatcacttaaactatctatacatttaaaacctttggtgatattcctgacctagtaagttcctaagaaaaaggtaagcatttataaagtaagtagaaatgattgtagacagcttttaaatggatttttttcctcataaactgttaagcaaagagtaaaagaatagaggtagtttaaaaatgataaattctagaacttgccatgattgttgtctggtaaaccatttgtgttcataaatttagaaccagggagaactgccgtggttgagacctggaagaaggtgcttgtctttgctatactagaatttaacttaaagtaggaggctattaagtgctgtattaggtgaaagtccagataagccaaatgcagtcatattgaaaatttcatctgtagttcttgtcatttataggcagtatacaacatgcatataattttatagtgaattttttgaaagccgtttattaaatatttcaatatttggagtcaatatttgttaaattgaacttctaagcctttttataaattgtaggttgttatgtagagaatgttatttttgtattcttatttaggaagctttagtttgaatatatttaacattgtggatgcaatgctaaggaataaatgacctttaatattttttaatacagtatttagtttcagacacagttctaaaggaacgcctggatccagaaacactggaatcattagggcttatcaaacaatcacagcaattcaatcaaaagtcagttaaaatcaagacaaaactcttgtaagtacacgtatcttatgttgcagatcaagtatctgagtatgttttttcgttcatattttgaatcctagtagcttctaaggggactttgaagattgttttttttgtttgtggttagcatgtcttgtgttttttgccttctaaaagtagcctaatattgagtcatcagtgatctttacctgtgcaaaaccattgttacttttgcccatattcaaagttaaaataatactcatgctttcatcattagcaataaaataatttatgactgtggctatactcagggtatattcttagagatggaaatggtgatatgttattgttccctgatattaacaatatccttttcttgtgttactggttttccctatgtaattaatattggggttctcatatgaatcactgttattttctactctaaaaggtacacaaagaggtaaactttcaacaactattcttaggattgttgtaggttggagataagaaaattcagtgagaatacagtactctgtgcaagcttgttaattaaaattaattttatccccttaatgatatttatctgatttcagttataagcagcaaaaattcaatttgttaagagaagagaatgaaggttatgccaagctgattgctgaattggggcaagatttatctggaagtattactagtgatttaatcttagaaaatatcaaatctttaataggtaagacatttatctgtatagtatgtgttgttaagataacaagttattttagctattggagaatatccataaagacaaaatgagtgcattccatctattttttttttcagttaaggaatgggagaggtgtttagcttttacttttaatggtttatcaataattataaaatttagcatgatatttgtgagaaatcttattgtcactataccttgtatgttaatattaggtcctgctctgtctagtctttcttttttgtggaggggatcctgagtggtaagccaacactttcaaaagagaatggatgacaaagaacaggatggactgttctgatagagtgccctacgtttctctagtatttctatttttaagtatttctcaaccattttatggaggaccaaaaagcaaacatgaaaactttaatacagtaaatcttcagtgaacttttgaaactacagatgtgtaattttgaacttgattttcaaaataactttacaagggactttgatacttattttatctttatagtagccttttaaagtaagtgcaacagctgttgtaaaagtgtaacagataggaaagttattattctccctaccctttaagtagaattcctgtagcattactgttttctttttatttgcattgagcatttggaagaagtagttgacttctgtaaaaaagatgaatgagcactagaaaaatagggtaatccagattttcctgaggtggaaagagtttttttattatttactaggtgttgtgctatcttagggaagattttgcagtacctgggtcttgagacctgccagaggagtcatattttgtgcctcactagttgtatcttaggggtgcttatcctcagcttcttgg

SEQ ID NO: 138859 - DNA, 1027 bp, Homo sapiens
cagaaaaccagatagcagggcaacaattgggagtccctgaaaaggattggtgagatacacatgggttaaaagtcttaatgagaaattgagattgtattgtaatttacattgcataaattataccctaaaatttccttaatacacatgagctaactgtgtgcttagctacagtggccaggatatgtagaaatggcaactgtccaagaagggaaagtcaagggccaggaaaatgtggatatgtttgatgaaaaatccctttctcttttgattcttagtgttggcagtagaacatgtagatgacaatttttattacttcactaaaaccagtgcttctctttatagcatattctaaattatgagttgactgtaaaattaggttaatagtatataatcagttaaagcagtaatcctgagatcagccttgtttgtaatcctgccaatgctggttgaaatttttggtgcttggcatttggcactaattgttttttttcttccacacttcagatcagaaaattttttgacaaattttctgaataatttactgaaactctcagtttttaaatatttcagtaggaagataaaaattttgaataatttctatttactgactagaattataattcaagataagatgttaattttttttttttttgagacagagtcttactctgtcacccaggctggagtgcagtggcgtgatctcggctcactgcaacttctgcctcccaggttcaagtgattctcctgcctcagcctccctagtagctgtacttacagatgtgtgccactgagcccagctgatttttgtatttttagtagagacggggtttcatcatgttgcccaggatggtcttgaacccctgacctcaggtgatccacccgcttcggcctcccaaagtgctaggattacaggtgtgagccactgtacccggccaaaaatatttaatactgtcttttcataaggttggtggccaggtagcttggttagaacatggtaatttgaccagggtggcgaaagtcatgggtt

SEQ ID NO: 138860 - DNA, 1930 bp, Homo sapiens
actagattatatttttcccttcatagttatttagtaatatgaattattgttacaagtcattgtcttgtacgagtaacatgaattcatgaagatgatgcttggttgcttttgggaaatttctcttagcctatccagtccattttttgtttgagatggcatcttgctctgttgcccagactgagtgcagtggcacgatcttggctcactgcaacctctgcttcctgggttctagtgattctcctgtctcagcctcctgagtagctgggattacaggcgcgtgccaccacgcctggctaattttttttgtatttttagtagagatggggtttcaccatgttggccaggtaggtctcaaactcctgacctcaagtgatctgtccaccttggcctcccacagtgctgggattataggcgtgagctaccgtgcccggcctatccagtccatttttataagcaagattatgacggcaaacttggaaagaggatttccctcacctgctccctcactcacctaccctcacccttggcagaaaaaaaatgattcaagtgtgatcccagatcaaggatggggaataggagtaagaatgctagctacctctaataataatgatgatgatgatgacaataataatgataacaatttaagttctgcttttagagtaccttccatgttctaggcattgtgttaagcatttaatctttgttttaatccttacatcaactcctgtaaaggtggtaggagtacagatcagaaaaatgaggttcagcgaagctgtgatttttcaaggccatgcaagccagtaaggcagaatttgaacctgggtccctttggctccacagcctatgatctttttattacatcatattgtcattctaaatgttgacagttacaagggaaattagtgctgcactttccgggttaagatagcaacttcctccccacccccccacccccccccaccccctcaccacctcccccccgccgcccccagccccgccccgagaatggagtttcagtcttgttgcccaggctggagtgcagtggtgcaatctcggcttgctgcaacctccacctcgtgggttcaagtgattctcctgcctcagcctcctgagtagctgggattacaggcatgtgccagcacgcctagctaatttttgtatttttaatagagatagggtttcgccctgttggccaggctggtctcaaactcctaacctcaggtgatccgcctgccttggcctcccaaagtgctgggattacaggcttgagctaccacgcccggctgatagcaactttaacagactaatagtatgaaggtgagggggcatgagagctatagaaagggggagtctgctgtaagttgatatgctgatggggcctctgggctggggtaggtaattggtgatgctgggcactagagctggaaatagctgagggctttttattgaaatcataggggaaattaaagagaatttattcgaggtaaaggagtcagggataataaatgagtttattagaatggtgttatgagttagagcaaaaagaataaagaaaccagggaaggtacagttgggataatagagtcctgtactgattgttgagatagctcagctaagaaatttactgagactcttttaagcgtttcctaacattgtcagaacccaagagaatggttagacatttaagtaatttatccaattctaagaattaagattaatgagctaaaataattcattccaggttcacaaaccctcagagagtaagtgtcttaatcaggttaagtggctgagaggagagacttgacttgaagaggatgaatctgccatccagtgcccctgttcttagggaccttgagaggtagatcttagggactttagggccctggagcatagatacatgttgggtaaaagaatgggcccagtttagccc

SEQ ID NO: 138861 - DNA, 1004 bp, Homo sapiens
tatcacaactcattgcaactttgatctcctgggcttaagttcccgcctcagcctcctgagtacctggcataacaggtgtgtgccaccacatctggctaatttttttttttttttttagtagagatgaggtctccctatgttgcccaggctggtttcgaactcctaggctcaagccgtcctcctgtcttggccccacaaagtgttgggattttaggtgtgagccactgcgcctggctaagaagatttttaaaatatttgattttttaacttgctgtttggttctgaaaaaattttgattccactcaaaaggagattataaatagactttattttacattagcatctttaaagcttcttgtttcactacttttcatgattggaaggaggtaaagttttcagtatatgggacttaaaaaaaagatgaccagaaggaggtgttcacctgaccactaactacccactccaaaaccaaaatatcttttttcaggaaaggggactgtggtaattaatagtgaatgttgctacttgtagttgacagttatcatagaactgccattttatacatgtattttttgtttgatttttatgggacaaagagatttagatttggggagaaatttctctcacactagggtatggttaaaactcggtagtatatgtactgctattctttatctgttgtcactatagtgctgagattgaattgagtatatatctgaagtctactggtgaggagaatgattggtttgaatccacttgctagagttcattgaatataattatagagacttgagtagcatgaaaaaatgctttaaaattgttttggggggaatcagaatgctatatgatgtgcatggtgaatttaaatatgtaaaatctgtagacatacagaaaaaactggaaaggaatgttcaagctgtagttatagtagtggagagatggttaacatttttctaaccttttaattttgtgtttttgtgaaaataaaagaaaaaattgctaga

SEQ ID NO: 138862 - DNA, 1048 bp, Homo sapiens
cagatacatctacttgttggggaaaaatctcagtgtttgtttttagtttcttgttataactaaggaatacctgttttttttttattaaaaaatttatttttaactaagttttttttgagacagggtcttgctttgtcacctaggctggagtgcaggcgatcacggctcactgcaggcttgaccccaccaggctcaagggattttcctgcctcagcctcctgaattgctagggctacaggtgcatgccaccatgcctggctaattaaaaacatttttttgtgcgggtgtatgagtagggatggggttttgctatattgcccaggctggtcataaactcctggcttcaagtgatcctcccccctcagcctcccaaagtgctgggattacaggcatgagccactacgcccagccaaaggaatacctcttttatactagggaaatgtaagtatctattatgcaaacaaattgccttattgtaataacctttcaatggttccatatgcaacttgagcaaatctttgagattctaactaatagttcatgatgacattgtcatctgtgtcctaatgaacatgtttgtagcctggtgactgacaatatagaattatatttcaattatttcttaaagttatgtaatgatgactgtaccattagtctaggtaggagtttgcaacactgatgcaacctcttccccgcaaccattggaaggctttttgcaaaagacatgcattaagattgttaaatagaaatgaaactattgaaaatgtgaggaagcaagtgcattgttataaggagaagttttttttttttttttttgagacagggtctcactctgttgcccaggctggagtgcagtggcacgatcttggctcactgcagccttgacctcctgggctcaagtgaataaggaggaattttaaacaattattttatttctctttctttctcatcctttccttttcctttcctctttttcttttttctctttttctatatgaaggaatatttgaaattgcattttagtagcccgagtacaaagggaaagatg

SEQ ID NO: 138863 - DNA, 1896 bp, Homo sapiens
ggaaggcaagatgggaagttacccagccagaccatcatcttcatcgatattagggtaatcccccaaaactgataaaagcagttcattgttttgtttactttcaaagccagctcatttatttaggggctgttatgtttgtagattgctcagcttcctcctttcagctactgttttttgacagttttacttttttttttcccccttgagacggagtctcgctctgtcgcccaggctggagtgcagtggcgcgatctcggctcaccgtaacctccgcctcccacgttcaagcgattctcctgtctcagcctcctgagtagctgggactacaggcgcgtgctaccacgcccggctaattttttgtatttttactagacacggagtttcaccgtgttatccaggatggtctccatctcctgacctggtgatccgcccacctcggcctcccaacagttttactattattgctgccaccttagcatgagtggtattagggctataaggtgaaattctgcttggcttctgactggtaatggtttgagaaaaagtgatgtaggagatcgaaatacttagataaaatggaattttaggttcacattatgtatatttacataatacatgctatctgtcatagttcttatgtttgaagagctgcttaaaaactgttattagaagccgagcgtggtggctcacgcctgtaatcccagcaaattgggaggccgaggcgggtggatcacctgaggtcaggagttccagacaagcctgaccaacatggagaaaccccatctctactaaaagtacaaaatttgccgagcgtggtggcacatgcctgtaatcccagctactcaggaggctgaggcgggagaatcgcttgaatctgggaggcggaagttgcggtgagcggagatcgcgctgttgcactccagcatgggtaacaagagcgaaactctttaaaaaaaaaaaaaaaacaaaaacccaaacaaaaacaaaccaaaaacaacagcaaaaaaacctgttattagaacttacgtgtatgtagttattgcatgacttgtggaatgtggattgaattatagtagatccaaatcagtatagtcagttttatgattgcattctgttacaggaagagaatttaaaattgtgtaacataataagctattttaaatagttaaacacatcaccatccagtacttagtttcagtttatttgacctgttttccctctatgaaactttgttgcatatagcatgtctttggagtttttgtgtcttcctaaagataggtgttagcattttcatattactaggcagaatacgtggtggtgcaaatatattacaaaaaacctttttcctttgtctgaaaacagcttctgaaatataaaacagcaactggaaatgttaaaaatgaaggtagtgtgccaccacattattagtgaagctatagatttggcgtttagaatatgaccaatatttaaaattataccttgggtgaatttttcctttttaacaagataaattagcagataagctttaacttgactgaaaattatctttttaaaaataatgtgatatatttcatgaggttgttaattcatttcttgtctgtcacttcttaccagcataaatcttttctgggggtggtagtcagctagtgttgaaagcaacataagagatgtatggggcattttataactttcagatagggcaaattcttaactgtacgccatgaaaaacaactgtctattaaatggaaggtcttgactttgaagaatgttttattaggtaattagagagaaaagtaaaactgtattttgcctatctgaatggtccatccatcacatatctagatatcccattatgtttccagagataccaattatgtttttaatgctaaattatag

SEQ ID NO: 138864 - DNA, 1921 bp, Homo sapiens
gagggagacgggagagggagagggagaaggagagggacccgattattttcttttatctcagcagtcagcagggcgtaatgtaatttatttgcttatatttatggctttcccaaagactattatttctctattcccagtgtctagcacatattaggtgcttgaaaaatgcgtgtttgtattagtggttaggggtagatattacggaagaagatgaagtctacttgttggcctgtggatggcatttctctgttctaatgggaagtaaggccgaagacttcggagggcgcaacccgtgtagtaacctcgcaaaggggcccgcgagtctccacgtcgttggctgccttgcctcgggtttccgctgggtggagaggaaagtggggcgggaaatcgaaaaacgaactctcagctcccggcattcctcgtgggcggtgctcccctttgacccttcgctcgcgtgctacacatccgggcttctgctactagtgagaggaagatggcggccgcggctgtggtggttcccgcagagtggataaagaactgggagaaatcagggagaggcgaattgtgagtgttcgggccggaggcaggcgcactgccgggccgggccagggcgtcagctgcactctcacctgtagtgggaggttgagggggaaagatgtaccccctcccccacccgggcggcgggcgtggatggtcgtctaggagtttcgaactcggggagaggtgctgtttaccgccgcggacctccttccttccctggcctcccagaaatcgctactgcctgcggtagctcggcttcctttagcctcttagtagaactcttattccgcccctgcaggtctccgcgctccctcttggtctctttttgtgtccccctcttcgcttgatctcacttggctcctttatctttatggggctgagccggggcaattcggactttccatctctctctgtgccatttcttcactctgcacccgttggactccgcagtttggagcttggcgcctcctctgcctgaagtccaaggagggcgaaccgtcccggattcccctcccctcctcttcgcccgctgccgcgaagcccggggcgccgcgaagaacccggtttggcacctctcgccctcccggggagcggtctctcgactgtcccggcctcgcgtagcgccgtggggaagtgtggcagggattgccgctttccctgaagaaccaccgacatttctttgctccgtcttttcaccttagagctatttcgggttggattcaactttcgtcattaaatgttccctaaaccccattttatcctgggactgcaactaattctggcagctctccaagcttctccagtacctaggataacgcgtttcctttagtcgtgaaactttcccccgtaacaccgaaaacagtaatttgccatacccctagtcttctcgcccccacgttagagcgctccctcctccccttcccctggaaggagtcgtttaagcagcaaagcaaacctcagatataagaacaaatattaataacatctcatttccttctctgggtcgcttttagatgctaaagctcaaccctggatgaaattaaccctcgttagccatttttgtcgtccttgcccacccctctccatttctagtagccagtttaccgtggctcatgctaaagattcaaatctttgtaacttcgttacttggaacgaaacacgaggaacgcgttgccggatcccgcgcttgtaatagtgccagcctatgtggcttcctcccccgcaccccccgcactgctgtatgaagtcttaacagtgtgagctctagaattccctaaataagcggctgtcttagccacttaagtagctgagtgaccttgggtaagttccttaaccacttggactgtttccccttgagtaaattgggaataataagtactct

SEQ ID NO: 138865 - DNA, 1025 bp, Homo sapiens
atgatatattatgtaggttaaattagattccatatatgaaaacattctaaattgtaaagcacattacatatgttagttattatcaaaggtaacatcgtgaaagaagagaagatgagctatagaatcacacaagcccatgcttaaattttgaccttacattaaaccaaagaggattgatttttttttttaattgagacggagtctcgctctgtcgctcaggctggagtgcagtggcgcaatctcagctcactgcaacctctgccgcccaggttcaagcgattctcgtgcctcagcctccttagtagctgggactacaggcacgcgccaccacgcccagctaatttttttgtatttttagtagagacagggttttgccattttggcgaggctggtctcgaactcctgacctcaggtggtctgcccacctcaacctcccaaagtgctgggattacaggcttaagccaccatgcccagccaagattgaaaatttttagtttaaattcagcatgtttagtagagaagtacttacttgtagctaaaatgatgggatgaaggaaaatgaaaattagtttgtagatagtatttgggtacatgcggacactcatgaaatatgttgtatcgtttaaatttggtttgtagcacagtttcctttactttgtgtcatttaaaaaaattaaaacctagacagaagagaaacgtactaaatgtttgaatatagatagcactgtggctttcagatagagttaaatatttttactgaagaaagagaaaagatgtgggctcttatccataacttgtttgatcagcctgggcaatatagtgagaccttgtctctacaaaaaaaaatttaaaaattagctgagtgtgctgtcgcctgcctggagtccagctcctcaggaggctgaggtggtaggattgcttgaaaccgcaaggcaggggttgcagtgagccaagattgtgacactgcactccagtctgggcgatagagcaagaccctgtcccagaagaaaaaaaaaagttgttta

SEQ ID NO: 138866 - DNA, 1076 bp, Homo sapiens
ggcggcacacacctgtaatcccagcactttgggagtctgaggcaggtggatcacttgaggtgaggagtttcgagcccagcctgaccaacatggtgaaaccacatctctactaaaaatagaaaaaaaaaaaattagctgggcctggtagcacacgcctgtaatcccagctacttgggaagctgaggcagaagaattgcttgaacctggaaggtggaggttgcagtgagcccaaattgcgccactgcactccagcctgggcgacacagcaagagtccgtctgaaaaaaaaaaaaaaaaacctggtgggttgctcagaggcagttacctatgtaacaagctggcagaaattctcaggataggcaaaaagataagaaccaaagaacatatccttccctttctaagtcataaaaattacttcctgtgaatgaaaagccaaaactttgcattaccaggccttgctattgatagtttacttggccagtgtattcacagagggaggaagcattgtcacatggcaaataaccagattacacccatagtctggttggcaggattgtacaagggtgcctgactaatcaagagtccacctgcttatttcttttcattagaatctaatatatttgctgtatagaatttagaaagttaagaaaagcgcaaagaaaataatctcactgctcagagataaccacagcagaattttgatatgtaatttagcctgtctttatatatctgtattttttataatttgggttatataatacaacatcattttgtaaccagctttttccacttaatacaacatcatggtgctcgctttggcagtacatatactaaaattggaatgatacagagaaggttaacatggcccctgtataatatatgcatgtttttaaaatacatcctgaacatgaatttttaatggttacctggtggcccatattaccatagtattgtcctcttttgttagatattgaattgtttttagtaaatagcactttatggaacatccttatatatacactcataatgaaatgatgggggattttttttttttttttttgagatggagtctccctc

SEQ ID NO: 138867 - DNA, 1026 bp, Homo sapiens
ctgcctcccaggttcaagtgattctcctgcctcagcgtcccgagtagctgggattacaggcgtgcaccaccatgcctggctaattttttgtatttttagtagagacggggtttcaccatggccaggctggtcttgaactcctgacctcaggtgatccgcctgccttggcctcctagaatactgggattacaggcgtgagccaccgcgcccggcctgatcagggatttatttatttttatttttttgagaatatgtttagaactagaatggatggttcaagagataatcatatatttaagacttttagaacatatattgccagattaccttccagaaaagatgtaccagtttttagttctaacaggcaaatgcctcttgcttcatactctccagccactgcgttttcgttgttggtagtaatgttgacctttgccaaataggataaaaatgttatcttttaaagtgtttatttctttgattattaatgaggtttaacattgttgcatatgtttgttgaccattaatatttcccacttgtaaatttgcctgttttctatcaacgtattaatctttttcttatagattttttttttttttgagacggagtctcgctgtgtcgcccaggctggagtacagtggcaccatctcggttcactgcaacctctgcctcccaggttcaagcgattcccctgcctcagcctcccgagtagctgggattacaggcatgtgccaccacgcctgactaatttttgtatttttagtagagacggtgtttcaccatgttggccaggctggtcttgaactcccgaaatcaagcgatccacccacctcggcctcccaaagtgttgggattacaggtgtgagccactgcacccagccttcttatagatttataagtgtattcatactactttttttgttttttaagacagtgtcttgacctgttgtataggctgaagtgcagtgacgcagtcacagctcactgtaacctggaattccttggcctacattgcccagtctggtctt

SEQ ID NO: 138868 - DNA, 1025 bp, Homo sapiens
agctactcgggtgactgaggcagaagaatggcgtgaacccgggaggcggagcttgcagtgagccgagatcgcgccactgcactccagcctgggagcgagactccgtctcaaagaaaaaaaaaaaaaaagaatttaaagaatatagttaaaggaaaaattcactgggctctgtgaaacaggttaaatatgtaaccacttcaaacagaaatgacttagtcctctcacctagttctgaaaatgtactaacatcccattttccatatcaaaagcacgtaatttcattagcaaaagcctctttgttttagacttaaaatcacctctgatccaccaaagtttatgcagttaccaaactactattttaataacattttgacagctttattaagataaaatttatataccataagatccatttaaagtatatagttcagtggcttttagtatatgcagagttgtgcaactatcaccacaatctaattttagaacattttcattactccagaaacaaccccagtaaccatttgtagtcacttcctatttccccctccccagccctaggcaaccactaatctactttctgtttctatttattttaataacatttcaaacttgtaatattattgttctcatgcttattctgggtcgttggctcagaggtttaaaagctcttaaactacccaaatttacaagtcctatgacatcctcattcagaaaacattcaaatgatggtttcataatgttatgatagttccatcttctaagagtttttgatctggagcatatgtttcaaattctatgtttgtactactgctaaattcacttaattagaagaagtaaaatcattctatcgagactcaagaatgagtttgttctgtttatgttaacgattccaggcttttgatggtaggaatggctttagcagtcttctgtggcacaccattatcttaaataatattgtcaccttccccactgtcttcatcctttggctcaaagtttggttcaatctgctgtggttaggcaagaag

SEQ ID NO: 138869 - DNA, 1958 bp, Homo sapiens
cagtacaaagcctgaagatgctttcacagagaagccttaaattatcccagcatactttattgcacccacaccttttcacttcaaaaacctttttgtcacccttgtctaatattcataccctattttcttctatattctcaattcatctgctccatatatacttgttttctgtggtatcattttccccacctccatttcacttagatcctatatttttttaccctatcttaccctttttgtttggtgccttcctccaaacccaaggtttctgtctttcatcagtcatccttccacctttcactcttaaactctggtaattctggttttcctccttctcaaaaagctcacactctgctaatgtgtatatattgttcacttgagtgcttctaaataaatatttacttttcaaaacagtgaaatctgaactattagcatggaaacaacctctgggaagataagatctccactcaaaagcttcaaattgagattctcctgctcatgttgaatgatggttttatctaatattttctgaaatagggtgactacttgaactacacaaaattgtgaaatgagaatatctttgattttatacttctatttttttttttttttttgagacagagtctcactctatcacccaggctggagtgcagtggcagtcttggctcattgcaccctccacctcccaggttcaggtgattctcgtcccttggcctcccaagtagctgggattataggcatgtgccaccacacccggctaatttttgtagtttttggtagagatggggtttcaccatgttggccaggctggtcttgaactcctgacctcaagtgatccacccacctcagcctcccaaagtgttgggattacaggcgtgagccactgtgcctggccacttacatctattttgattgacttgaaataaaatttaacacctcagggaaggcaattctcatgtgttttgaattatactgagcattaattcttcaggataattatagacttggaaaggtttaacccagtctcccagtccatgctgaagttcctttaagtgataggaggaactcataatctacaaggcaacccaatccatttggtgctaccatcgattgttataaagcccatccttgggttaaaatctactatttacagttgtatttaatgaccttaattctgccctcaagctatataaaatttggatctgttttctacatgataatcttttagatatcttaaggtagttagtctatcctctctacccttcccctcacagtttttccaccctttgagataaatatccttcgctattccaactatttctcatatggtatcatttttatcatcccgattgctccctaaggatgttaaactttgttaatgtcccttccaaaatgtatttggaactggaaataatatcccttggtagctgaattggatctggatgttgcacatctggacactaatgcagtctgaagttgctgtaagttttttagtcgacttgtaatgttggcttatgatgaatttgtaattaaataaaatcccaaggttttaatctggaggattgcctttaagtgatttcttcttaaactaagtctcaatcttcttttagttatgcaacagattttttttgtttgttttttgagacgctcgctctgtcgcccaggctggggtgcagtggcacgatctcagctcactgcaacctccacttcctgggttcaagcaattctcctgcctcagcctcccaagtagctgggattacaggcatccgccatcatgcctggctaattttctttctttcttttttatttttttttagtagagacggggtttctccattttggtcaggctggtctcgaactcctgacctcaggtgacccaccctcctcagcctcccagagtgctgggattacaggcgtgagccatcacgcccggccttttttgagatggagcctcgctc

SEQ ID NO: 138870 - DNA, 2137 bp, Homo sapiens
accaagggaagttaatagcaaaagtaactgcagggcacatgtatgtcatgggcaaaaaaaaaaaagtaacagcaattaaggtttgcaggtacttagaatttttcctgagccaccctctagagggcagtgttacatatatatctgtaattatccagttacaacaaaaaaagggctctcattcatgcatgaaaatcagaaatatttcatactcttaaagaacacattggaaccaatattatgattaaaacatattttgctaagcaaagagatattaaaaattaattcattaacattctgaacattttttaacttgtaaaaacaactttgatgccttgaatatataatgattcattataacaattatgcatagattttaataatctgcatattttatgctttcatgtttttcctaattaatgatttgacatggttaataattataatatattctgcatcacagtttacatatttatgtaaaataagcatttaaaaattattagttttattctgcctgcttaaatattactttcctcaaaaagagaaaacaaaaatgctagattttactttatgacttgaatgatgtggtaatgtcgaactctagtatttagaattagaatgtttcttagcggtcgtgtagttatttttatgtcataagtggataatttgttagctcctataacaaaagtctgttgcttgtgtttcacattttggatttcctaatataatgttctctttttagaaaaggtggacaagtcctattttcaagagaagatgacttttaacagttttgaaggatctaaaacttgtgtacctgcagacatcaataaggaagaagaatttgtagaagagtttaatagattaaaaacttttgctaattttccaagtggtagtcctgtttcagcatcaacactggcacgagcagggtttctttatactggtgaaggagataccgtgcggtgctttagttgtcatgcagctgtagatagatggcaatatggagactcagcagttggaagacacaggaaagtatccccaaattgcagatttatcaacggcttttatcttgaaaatagtgccacgcagtctacaaattctggtatccagaatggtcagtacaaagttgaaaactatctgggaagcagagatcattttgccttagacaggccatctgagacacatgcagactatcttttgagaactgggcaggttgtagatatatcagacaccatatacccgaggaaccctgccatgtatagtgaagaagctagattaaagtcctttcagaactggccagactatgctcacctaaccccaagagagttagcaagtgctggactctactacacaggtattggtgaccaagtgcagtgcttttgttgtggtggaaaactgaaaaattgggaaccttgtgatcgtgcctggtcagaacacaggcgacactttcctaattgcttctttgttttgggccggaatcttaatattcgaagtgaatctgatgctgtgagttctgataggaatttcccaaattcaacaaatcttccaagaaatccatccatggcagattatgaagcacggatctttacttttgggacatggatatactcagttaacaaggagcagcttgcaagagctggattttatgctttaggtaaactttattataaaaccaataaatagcttcccaagtatgccagggctcataaaaagtaaatagatgcccttagccccctgaactggtaaatatttaggtataacttggcatgattatatatatatctgtattattccgtgaactcttatgttgaacctgtaatgtaactactgaatttatgtgaaaaagactaccatattatgagtcatgcttctcttcatgtaattgtttttaggaagtagataacttgcaaaagatggtagacatccccaatagcaaaatgggtctaatagtaatattaaccatcatttattgagcacttactataagtgctcaatacatatacttcatgcattttctctaagcttcacaatagctttgtttgtttgtttttgagacagagtttcgctcttgttatccaggctggagtgcaatggcgtgatttaggctcaccacaacctccacctcccgggttcaagcgattct

SEQ ID NO: 138871 - DNA, 1065 bp, Homo sapiens
gtgactcagtaacaacatccactctttaagtaacttaggttaattgttaatgagtacagctagattcaaaacagttcagatttttgaagcacttaacctttttcttgcctattttaccttgcatcgtttcaaacactacaaaatacatactcattgcatttacaattaattgtaagattctgaaagtgatttttcagtgcctgaatacttcaaaaaatcttcccaaagcagctttgctttgctggtttgtttttattctttcgcttgctccttaattttttcattttaactatattttgctattgagttgtgataatgaaaataattgtttaaattctatgttctttttcctcaccaatttttatttcagatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcaagatgagtcaagtcagacttcattacagaaaggtatgcattgctgtttttaaaaagcaagaaagggccagatgtggtggctcatacctgtaatcccagcactttgggaggctgggacaggtggatatggacattttttaaacgtaaccttaatgctgtgtgttagtctgctcaagctgctataataaaattccatagactaggtgtcttaaacaacagacttatttctgacagttttggaggctccaaaatcaaggtgctggctgatttggttattgatgagggccctcttcctaccttgcagatggctgccttctcactgtgtcctcacatggcatgggttgggattggatgggacaagatggagcaagtactctggtctcttttcctctacttttaggaacactaatcccatcatgggggggtctcatcttcatgacctcatctaaacctaattacttcccaaaggcctcatttccaaatatcattacattaatcatggaaaaaagattaaaaatatgagttct

SEQ ID NO: 138872 - DNA, 2368 bp, Homo sapiens
catcttgtcccagagcactttgtacataactttattatagcacttatcactttgtactttgtgcttaacctcctagcctcatcttacatcctctcccactagcgtgtgagctatttaagagcagatgccacgggtgagtcatcctcatatctcccggcacttgttgggtgcttggcacgtagtaggggctcaataaatgttttcaatgaatttaaacaactaagagagtctaaaactagcataattattttctctttttgcagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttaatctaactctatagtaggcatgttatgttgttcttattaccctgattgaatgtgtgatgtgaactgactttaagtaatcaggattgaattccattagcatttgctaccaagtaggaaaaaaaatgtacatggcagtgttttagttggcaatataatctttgaatttcttgatttttcagggtattagctgtattatccattttttttactgttatttaattgaaaccatagactaagaataagaagcatcatactataactgaacacaatgtgtattcatagtatactgatttaatttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgtttttagaggttggttgttgtgttttaggattctgtccattttcttttaaagttataaacacgtacttgtgcgaattatttttttaaagtgatttgccatttttgaaagcgtatttaatgatagaatactatcgagccaacatgtactgacatggaaagatgtcaaagatatgttaagtgtaaaatgcaagtggcaaaacactatgtatagtctgagccagatcaaagtatgtatgtttttaatatgcatagaacaaaagatttggaaagatatacaccaaactgttaaatgtggtttctcttcggggagggggggattgggggaggggccccagaggggttttataggggccttttcactttctacttttttcattttgttctgttcgaattttttataagtatgtattacttttgtaatcagaatttttagaaagtattttgctgatttaaaggcttaggcatgttcaaacgcctgcaaaactacttatcactcagctttagtttttctaatccaagaaggcagggcagttaacctttttggtgccaatgtgaaatgtaaatgattttatgtttttcctgctttgtggatgaaaaatatttctgagtggtagttttttgacaggtagaccatgtcttatcttgtttcaaaataagtatttctgattttgtaaaatgaaatataaaatatgtctcagatcttccaattaattagtaaggattcatccttaatccttgctagtttaagcctgcctaagtcactttactaaaagatctttgttaactcagtattttaaacatctgtcagcttatgtaggtaaaagtagaagcatgtttgtacactgcttgtagttatagtgacagctttccatgttgagattctcatatcatcttgtatcttaaagtttcatgtgagtttttaccgttaggatgattaagatgtatataggacaaaatgttaagtctttcctctacctacatttgttttcttggctagtaatagtagtagatacttctgaaataaatgttctctcaagatccttaaaacctcttggaaattataaaaatattggcaagaaaagaagaatagttgtttaaatattttttaaaaaacacttgaataagaatcagtagggtataaactagaagtttaaaaatgcttcatagaacgtccagggtttacattacaagattctcacaacaaacctattgtagaggtgagtaaggcatgttactacagaggaaagtttgagagtaaaactgtaaaaaattatatttttgttgtactttctaagagaaagagtattgttatgttctcctaacttctgttgattactactttaagtgatattcatttaaaacattgcaaatttattttatttatttaattttctttttgagatggagtcttgcttgtcacccaggctggagtgcagtggagtg

SEQ ID NO: 138873 - DNA, 1591 bp, Homo sapiens
ctggaattacaggcaggtgccaccatgcccgactaatttttttttatttttagtagagacggggtttcaccatgttggccaggctggtatcaaactcctgacctcaagagatccactcgccttgccctcccaaagtgctgggattacaggcttgagccaccacgcccggctaaaacattgcaaatttaaatgagagttttaaaaattaaataatgactgccctgtttctgttttagtatgtaaatcctcagttcttcacctttgcactgtctgccacttagtttggttatatagtcattaacttgaatttggtctgtatagtctagactttaaatttaaagttttctacaaggggagaaaagtgttaaaatttttaaaatatgttttccaggacacttcacttccaagtcaggtaggtagttcaatctagttgttagccaaggactcaaggactgaattgttttaacataaggcttttcctgttctgggagccgcacttcattaaaattcttctaaaacttgtatgtttagagttaagcaagactttttttcttcctctccatgagttgtgaaatttaatgcacaacgctgatgtggctaacaagtttattttaagaattgtttagaaatgctgttgcttcaggttcttaaaatcactcagcactccaacttctaatcaaatttttggagacttaacagcatttgtctgtgtttgaactataaaaagcaccggatcttttccatctaattccgcaaaaattgatcatttgcaaagtcaaaactatagccatatccaaatcttttccccctcccaagagttctcagtgtctacatgtagactattccttttctgtataaagttcactctaggatttcaagtcaccacttattttacattttagtcatgcaaagattcaagtagttttgcaataagtacttatctttatttgtaataatttagtctgctgatcaaaagcattgtcttaatttttgagaactggttttagcatttacaaactaaattccagttaattaattaatagctttatattgcctttcctgctacatttggttttttcccctgtccctttgattacgggctaaggtagggtagagtgggtgtagtgagtgtatataatgtgatttggccctgtgtattatgatattttgttatttttgttgttatattatttacatttcagtagttgttttttgtgtttccattttagtggataaaatttgtattttgaactatgaatggagactaccgccccagcattagtttcacatgatataccctttaaacccgaatcattgttttatttcctgattacacaggtgttgaatggggaaaggggctagtatatcagtaggatatactatgggatgtatatatatcattgctgttagagaaatgaaataaaatggggctgggctcagtggctcacgcctgtaatcccagcactttgggaggctgaggcaggtggatcacgaggtcaggagatcgagaccatcctggctaacacggtgaaaccccgtctctactaaaaaacagaaaattagccgggcgtggtggcgggcgcctgtagtc

SEQ ID NO: 138874 - DNA, 1051 bp, Homo sapiens
gaccaacatggagaaaccccgtctctactaaaaatacaaaattagctgggcgtggtggctcatgcctgtaatcccagctacttgggaggctgaggcaggagaatcgcttgaacccaggaggcggaggttgtggtgagcgaagatcgtgccattgcactccagcctgggcaacaagagcaaaactctgtctcaaaaaaaaaaaaagatataaatcacaataaataaataggtcaatacaaatgttagccaggcgtggtggcacatgcccatagtcgcagctactctggaggcagaggcaggaggatcacttgagcccatgaatttgaggcagcagtgagctatgattgtgccactgtactccagtctgggtgacagagtgagaccccatctctaaataaataggtcaaacccttaaaaatatttaaattcttaaaaaattgaaaagattattcttctcaaatttagttgagctttctaagagaagcaattggctttttcccacttcaataatcattttcagtttgactcatacagttaacacaatgtgaatttcttcctcagcataacagagttatagaatgacagggctggaagtgaccttagagagtatccagttctttcattttacaggtgaggcaactgagactcaaaggtgatgtaatttgtgcaaagattatagctaattagtagcagagccctgactgggacatagtttgaaggtgaaaaacttcaccaagctacctttcttgaaaggtccaaatgtttatgttttcaactactctttccactgtaccataactttcactacatattaaatgacactttataactaatataataggacaatcatcaatgcatatatagccagcccttcatatctgtgggttttgcatccatggattcaaccaaggaggaattgaaaacactgagaaaaaaaaaaaagaccacacaataaaaaaaaaaaatacaaaataatacaaagaaaaagccaaaattgtcatactgttgttaagcaacagtataacaactatttacatagcattaaggttgg

SEQ ID NO: 138875 - DNA, 1322 bp, Homo sapiens
cactgctcccggccttgtgtgattttatctaagggacttaagcgtcctcaggtcctagggggtcgtgaaaccaaaaccccagggatagcaagggacaattgtatcttcaaagtagacaaatggcgccgggcacggtggctcacgcctgtaatcccagcagtttccgaggctgaggcaggcggctcacctgaggtcaggagttggagaccagcctggccaacatgctgaaaccctgtctgtacaaaaatacaaaaatagctgggcatggtggcgcatgcctgtagtcccagctactagagcgactgaggcaggagaattgcttgaacctgggaggcggaggttgcagggagccaagatggcgccaccgcactccagcctaggtgatagagtgagactccctctcaaaaacaaaacaaaacaaaaaaattagacaaatgctacattaatgtttgggtggtcagattctactttgaatctgaagtttgcagatatgcctatagatttttggagtttaccactttcttattctgtatcattaatgtaatattttaaattactatatatgttaccatttttctggatttagtaagaaatttgcagttttggtttgatgtaacaagggttttaatgtaatttatgttagattttgcatttttttcattactgttatattttaacctgactgactgatctaattgtattagtattgtgaataatcatgtgaaatgttttgagacagagtactatatttgtgaatataattttatggtttttttcacttagaacctttctgtgtggaaaactaagaaaattgctttctgctgtataatctggcattcattgtagattaaagcttatttttctgtgaataaaacgtattcaataaaatactattctttaaaattatatcatactaccttgtatttgtttcactttcttagaaaaaataaaatcaccctcttaaaaatactgcaatgtaacctcctaaatatatcttatgccattgtacgtaggcgtaaggtacacattaggtcatgccatgttttaaaagaaaagacatcagttttcacattaatgtatggaattctataagtgcatgaaatgtcaatttttaaaatgtatatatatatgaacaatggtaacaccactccctccaaaaagatatgcctggttgtctcaggagatagtatactcactataacagaacttgaacaggcaaatagcaatgaacctaaaaaaccactgcccctttgaggcaggcagcaaggaaggatatttgtgagtttgcggaagcaactgccagtgagtttcagaagctgtga

SEQ ID NO: 138876 - DNA, 1725 bp, Homo sapiens
cttcctagagagggaacaacattcatgtgacgggcccctctgcttctcccccgccccatcatctccagcgcgtggtgggggaactgctggggaaggcgattggcatcgatctctccatcccttccgaggcccgacttcggtcagttttcttcgggcaacaattttctaaattggctggggtctggcggtgttggcccccgcgcgcagaccttgccccgaagggggccctgcctgcctggcatgggcggaggggggaagggcgggagtggaaggctgtttgttggggggttttggcgccacttttgttttagttttagtgctgcttttcattcccacccccacccgcactgtctttctcaaggcacgaactgagctgatccttgccccaggtaggcagcctgtgcgttttcactccacacttttattcttgctcggggtcgactttcttttttcttctcccctggatccggagatctgcggacggcgattttgggacgaaaagggtcggatgggccgtgggagagagaaggtgtgggaaacagcatcaagtagttccgcaaaactttgagccccgttcccattttcttttggcctagaattgtgaacgtattgttgatttcggcctttttttccccccgtcgcgagaatgtcttgttttgcctttagttttttataaaccgctgtactttcgacatttagtttccgctcccccttggtgcatatgtcattttatttttaatccttaactgtaatgggttatcgtgtgattttcgtgcttcagtgctcggctttaatttttaatattgtattagtagtttcatccggtttgtgagactttctcttccgtggcctagaatgttttttatgttgttgcctaccacccctcttccctctccctccttctttctcttggatgtagtttttaaattgagggccatggtgttggattaaatggtaatttacagtttacatgatatatctattggaaacttttgatctgtaaggttagatttaaagtaaacgaggcgcttgtgttggtttgcaatggttccttaaaatgcgcgggccacccccttctcccaccataaagccccatcttcccttcacactggagtgtaaattccataccccttttctcccacggaccgccgtatttcgcagcagccacaccctgtatttgtctctgtggattggactcattatcagcttaatttagtgactcttaaaccaccatgatgggacttgcttaagcacgaagcttcttttcctgtttagtcctagtggttagtgtcgaaagaggaatcatcgaggtttcttgatgaaacctagtgcggtccaacctctgcctttttttctgttgtcttttttcctactccgggctgttggcggtgtcagcaccgctgctgggggcgggggtggaggggagaaagagtcgggttaccgaagtgcgtcattcctggctctagcagggcctgctcgggagctgctggtgtttgttactgtcctcgcagcacttttctgccaaccttctctctctgcgtattggttaggagcaaaagcaggaggcggtctcctaattctgtctgtagcctagcgcgttgcgtttaagggtatatctgaacttattttgttaaaaaaaaggctctgggaagtggatgcatttgtttaatgacatataattcaggtagtttaggcttgctctcatatactttccgatgaacagtg

SEQ ID NO: 138877 - DNA, 1993 bp, Homo sapiens
ctgtatagttacattgttggattttgacttaacatgctagtttttgatacttttgctatctttgggtagaagtgtacttagagaacatagtatcttcctcttaattctttttgaagataataatgagaggagggagtgggtaggaggtaggtgtgaagcagaagtggccttgagttgattattgtagctggatgaatacagaagcgctcattgttactattattctctctacttttgtgcgtgctgttaaacatttccatagtttaagataaactttttttgcagtagaatttccagattgtcttacagtcttgggggtaatgacttaagtttatatttacatgtcaaaattacttgcataggaaatttagccttgtgtaagtgattacacaatgcttggcaaaactttcaaaaaaaaaaaaacgtttaaacgggaactagtataaaacaggcaacataaatacttataaattggttgaactttaaatgtttataacttagcctgaatgtgctctacttttagtttcctttttaattctttgaaaacaggaaaattccatttgcaatttttgtaaattctgcttagtgtctatttcatcaagttggagttacagtgagtcagtatgaaagggatttactattaataggaggggctttggcagttgcagtaagtgacagtggaagggattgaggtaccatagggagcattcctggtagaaagatctaggtagctgaattcagtttcagaatttggtgtttaatgactaggtagagaagtgggttggaaaagaaatgtacttattagctattccttcccactgtgaagtaactatagtattctaaggtgtatcagagactggcagagagggtggagtgggtttttttttttttaactgataagaaaatgagtgtttacatttaaaatggtttaaatcacctcatgccccaaggatctggtgctataactagttagaagttgatatgtaaaatatttcaatattgtctgttaacattctgaccattacccgtaaacagtaaaaatgtgttgcaatgacaatccttggtctcccttaattagtgcatttgtgaactgctcctaaattctattaaggtaagtgccttttttttttttttttttggcagttctatactgttcagtgtcaggtttatttttttcccccaggagatacattttaaaaatacatgtcacagttccgaaaggaatccaaaacaatggatatttaatttatagcaaaatttcaccccaatctgggaacagacattttgtaactgttaccattagtctgtttgtgtatttcatattcaggattttagctttagaaggatgttaaaggaaaataggtgacatatttcaaatttttattcatatacaaatattcttagtagatggtaaggattgtggcatcagatttattttattgtggtgaggcaatagctaaactactacactaacacatgatgagtttggtaactttcaagtatatttagttaggattttttaaagcccaaatgctcaaataagattttcatgaaatcaaattctacatttctttttcaactgtattgacttctgcggtcacctgaggacttatgaattaaagtgaatgggatgggcttgggggacaggctaaggctcagatctattcctttgggaatttagggttagatgtgaaaatatgcagtttagtaatgcttaatattgtgcatgtttaactgataccacccacagtcatatgtgggaaggtagtaaacagagaatagcataatctttctgcttcgggttctttataatagatggcagacttcagtttttgatgctgcaagttgacttttgaacttaaaccaaaatcggcggggcacagtggctcacacctgtaataccaacactttgggaggctgagaggctgaagtggggggatcacttgagcccaaggagttcaagaccagcctgggcaacatagggagaccccat

SEQ ID NO: 138878 - DNA, 1029 bp, Homo sapiens
ttcagtgtaagtggtgttgcttagtggagtctaatttttgttgatgtgccttttaaaaatctatgcatcttcagcagctgtggtaatctgctacctgaattgtgtttttaatgtgtgcttgctatagatctttgatactcaccagtagacaccaagaagtctttacatatggttattgtagtaagtcaagaagagatttatttattttttgagacggagttttgctcttgttgcccaggctggagtgcagtggcatgatcttgggctccctgcaacctttgcctcccgggttcaagtgattctcctgcctcaacctcccagtagctgggattacaggtgtccgctaccacgcccagctaattttttgtgtttttagtagagacagagtttcaccatgttggtcagggtggtctcaaactcctgacctcaggtgatccacccaccacagcctcccaaagtgctgggattacaggcggagccaccgtgcctggccaagaagagattattgaaattgttttccattccttctgccgaagaaagagaggatgaataatgtcaatggtgtattttttttttttttttttttttttttgagacggagttttgctcttgttgcccaggctagagtgcaatggtgcgatcttggctcactgcaacctccacctactgggttcaagcgattctcctgcctcggcctcccgagtagctgggattacaggcatgtgccaccacaccgggctaattttgtacttttagtagagacggggttttttccatgttggtcaggctggtctcgaactcccgacctcaggtgatctgcctgcctcggccttccaaagttctgggattacaggcgtgagccactgcgcccagctggcctattcttttttattacagtcatgcattgcttaacggcgggcataccttctgagaaatgcatctttaggtgattttgttgtgtgagcatcatacagtgtacctacacacacctagatggaatagcctactatacatctatgccatatggta

SEQ ID NO: 138879 - DNA, 1881 bp, Homo sapiens
tgcctgaggtctatattgtcttttaatagtaatagaagtagttgaaataaatctgagcattggttttgtttgcatatgcttattaaagtttgtgggataatgaattgtattcttgaattttttggggggggaatcatgtgatacatgaaatggtttcatagatattttttcttttaggtcatttatgctctatttaaaatggagattacatgtgtctgagaattgttccccagtccttcagcttgttttactgagtggttagattcgaagtaaaaagtttaggctaatctttaataattcagcgctctggttctttaggggtattttttgttatttaattgtaccttaaaaattcttttttattctgttaatatctcctgtttgcttatacttcctattttagttcatctttcactattaagttttcttgttcttactgttatcaggtgataaatagttaatatcagggccccaagttattaggttcattagtgatcggtatcttagtctcagttttctttttcctttctgttttttttttagatggagtttcgcgcttgttgcccaggctgtggtgcagtggcatgattggctcactgcaacctccgcctcccaggttcaagcgatttcctcgcctcagcctcccgagtagctgggactacaggcgcgtaccaccacacccggctaattttttgtatttttggtagagacgggatttccccatgttggccaggctggtctcgaactcctgacctcaggtgattcacccatctccaccccacaaagtgctgggattacaggcgtgagccaccgcacccggtcttcctgtttttttttttttttttttttttttttaattgtaactgaagttttttttatctgaaggaattctggttgttggacttatgacctaagataaatttatggagacaaggaaaacaaaatatatatatttgtgcttttcatagccatgagtcaaatttatatgtttatattgatcattcctttaagctttaacatgtaggaaatacttttttcccaggtgatgaacagcagtcttatactcagactctttgttcattgaggagtcttttcatccatatttccccctttgtattccaagaaaaccaagaactggtgttccatgacagaattattccccgaggcatccattgtatattataaattagtttctcccctgcacatctagaaagatattagttaggtatcattcttgggagacttcaggaatagtcactgaagtcattttctgagttctgtagtcaagtcattttctgagttctgtagttaacatgaggaacactggttgagaaaggctgctagaatattaagggacttggtttggcactaaataaagttttacttttcactgtcactttcctgttagtaactctaatatggcctctattaaaattcgtgatacaatgtgaatgctgttgatactgctattgctgtgggataaattggttagtgttgatttcaagcagttagtgctgcttagttgtttgaaagaatttaatgtgggacattaaatgcatcattttatttataagaaggaatattgtgggagcactgttcattatacagttcaaaatctataaaaagtcactgacagtgactaacatgaacaagaactaatactaactgaactcttaccatatgccagatactcttaaaaatgctttgtgtgtattagcttactttatcttagtaactctatgaggtaggatgaccatatgatttattgttcaagccaggatacttttgaacgtgaaagggattgcttcttggccttttggctaagatcaagggaagagtgagtgaaagggggcactcactgaatggcatgctgagataata

SEQ ID NO: 138880 - DNA, 1051 bp, Homo sapiens
gctcaagagccctggttacaggatcttctggggtccaaataccctctagaggttttccgttggccacttggtgtacaccccatgcaaatgaagtagtggcctgtgatcagtctgattgattgtggaaagcaagcaattgggggctgaagtgaagttacaaagttacgctcctatgcaaactttgtaactatacaaagtgatactcttaagaaaggtactttcagttttccctctgccacacagaggtactttagtatggagagttacttaggtatggagggttgaggttttccttttgatttagttctaggaagtcagggtgaataggccttattccacctgcctccagaccccattctcttgcctcaaaagaacaaactttactatgtacatattttgatggtgtcttttcagagttgtgtttaagatgcagtttttgttctcaatgtccacagtcttaatacagaaggtagctaatgaaacaaaaatactagaatagagtcattattgtaatgatggaaacttacataaagtataggaacagaaagaggtagtgattatctcagagatttcaaggagtgtgtcttacagaggaggcgtagtgattgaggttcagtagtttatcacgacattccaaaccacctgacctccatctcgcataactctaactgctcttagttccctggggacaccaggctgtttgcctagatatttctttgcttgggctgtttctaatgcctagaatattcctgtacccacttgccagcataacagtacatgtccttccagatttagattgaggttacttgaaaaccatacctgaggtttcctttcccagaagagctactttctggtgccctgaggcttcctaagcatattcatgccagtgtgctttcagtgtaccctatagtaatcacttgtgtgacaccttcactatactttaaattcactggggggagagagtatgttttattcattttccctgaacattttattatgaaaaactccaatgtacataattgtatagtgaatactcatatacctatcacct

SEQ ID NO: 138881 - DNA, 1046 bp, Homo sapiens
ccactgtactccagcctgggcaacagagtgagactccatcaaaaaaaaaggaaaaaaaaaattgtaagcattaatgttgtaaataagagctttggcattagatttaatcaaatgatgcctgtgcgacctttggcaggttgttgtcttagtgtcagttgtttttttttttcttttttcctgagacaaagtctcactctgtcgcccaggctggagtgcagtggcatgatctcactgcaacctctgcctcctgggttcaagcaattctcctgccacagccttccaagtagctgggattacaggcacccaccaccacacctgaataatttctgtatttttagtagagacatggtggggggtggtgggcggtgtgggtttaccatgttggccaggctggtctcgaactcattacctcaagtgacccgcccaccttggcctcccaaagtgcggggattacagcaggtaggcgccactgcatctggccagtatcaatttcattatctgtaaaatgggcctaatagtactttactcataaggctgttacgaagattgaattgagtaatgtttgaaaattgcttaacattttatggttcccagaacatagcaaggacttaataaatggtagttattattgacaaaaatgaaaatgtcaaggaaaagtataagaacatatcctggaatgttgtaaaaggaaggtttcagcaatatttagggaacctgatagctagggcaaaggagtatatagatacttttattgtttaaaaactcttaagaacaacaaagattacatattagtttagactgagttgtcccccccttacctccctagggctagattgagttgattatttcattgagctctttgaagtattgttaccaataaatacatacatagatttactataaattaagcttcttcaaggaagggatttgggtttgtttgggtcacggctgtatttcagcaccagtacttttactcttccaaaatttttcgctgtgggttttcaagtagaaaatgttgtctgatttgagttttatttggtcttttt

SEQ ID NO: 138882 - DNA, 1022 bp, Homo sapiens
aaatataattttggtttggtttgggtttgcttttgctttatatctgtgcttatcacaaggatgttttgttttgatgagggaggcttttaaaatttttaacctgagtaattggtatatattttcattgattaaagtgaattcagaatatctatcttgatcttaaataaagagctgaagtgttcagaggtacccctacctttatatattgttctcttgcctactttgaggatttattggagaagaaaggtgagataaagataccttttcatgcttttgtctagggtatttcaaaagcaagtgatatgttaagtcatgcattctaaatgaaattgctgttttaaatttttgttttaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcaggtcggtatttagaaatattttctgcatattgtcttagatttgagatgaaaaagattctcatttaaagagaaaggaaataacagagatacaaattaattttatttataaagtgaccactaagaggacactcccccatccctcctgcgaattcctggaaatgggatgataatttcagttttgattttgtgaaggtatactataactagtatttggtaattttcttgtatactatgcatactgtgccacagcaggggagaattggacaataggtatgtgttgggttcttgaaaaatactatgccacagcaagggaaaattggactataggtatgcattggattattgaaaaataccatgccacaagaagggaaaattggatgataggtatgtattgggtttttgaaagatatgttaccagggaagatattgacagcagatttggagatatcatcacagtcattttg

SEQ ID NO: 138883 - DNA, 1060 bp, Homo sapiens
actaaaatttactttagaaggtgaatcatgatctatgaaaatgattattttagaggacatattatagaataatgggatttaaggatagactggagtcagattgccttggtttgaatcctggtttgactgcttatatgaactgaggcaaattttaaaatttccctgagcttcaattttgccgtgaatgaaatgggtataatacttacctttgagagggccattgtgaggattaggagataattcctgaaaagttattttattttatgttattttattgtcatttgtagcagctgcatctttcttttgttagaagcagattagctcatttctgcttaatatttctatttgatcttaaattgtaaatttttgtgtctgttagattagtttcaccatacttttactctttaaaaatagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagaggtaaacttttatattgaatatttaggctattgtgtgaccaacttggtcaccattaattaggatataactttgctagtggctcagataattgtttttgaaatatttaaatgtaaataacatttcaaactatttgcccaacaaaattctgatgaatatccgtgccaacaatactgttttcttattttcaacctgcgtggactagtattaagagtggctttaagtaaggggactggggttagtctgacaagttgtcttaagctttagtattattcatctctacggtgaaaaaccttttgtcaggatgaaaagagatttcacaattaaaatcactttggaaaataaaatcactttgaaaaataacataagctgtttattggcatctaaatcagtgttttttatacagtagaaggcatttgtttaacattaatgactgaccaccaaattcaactctgaatgaggaaaataattttttcagccttatgcgaaataacagt

SEQ ID NO: 138884 - DNA, 3555 bp, Homo sapiens
tggttactgttgtctagtataattcaaaattccccaaaatactggggaattctgctttttttgtgcttgtaacaacttacaggtgttcatttggttgtcttcctttacaattgaaaagaaatgatgtgtttttttacagcttcaggaaaatcaagatgaaatagaaaatatgatgaatgcaatatttaaaggagtgtttgtacatagataccggtaagttgtgacagtttttttcataaatagcattatgtaatttctactcagcaagtttgcatatttcgtggtgtagggaatctaaattagcaggaagaatgttatagtaaaatcaatgttagactccattagtgccactgagtcactctgggcaagttatttaactcatgtgagtttggtgtttcccatctgaaaaatgggataatgctgtgcttgacttgcagccagtagaagttactgctatttggagttgggctacacaatacttaattgcctttggatgcactatgttagtagagcctgcacgtgctgactcctgactctcttcccttccattgaatatcagtgggaacaattggataggttaaagtgagatattttcttttgctgttttgaatgaacagaggaaagaaatagtaatcttataaatttatgctgtaacctattcttaaattttggtagtatttttattcagcttccacatatcctcaacttggcagttactgaatcaggttaatgcttactttttgtaatgtctccatgtccattcttaccttttcacttctattgtcaccattaccttagtctgtttcctcattctcatgcctagagattattgcagttttgccaaaatatccttttattgtgttattcctctgccttcaatgactcaccagtacttacaagatgaatttaaaatcatttattctaacattcaaatcccagttgagcttgacctcagtgtaatgtataaataatacttacctggaaattacgctctagccagacaagtgtgcctgctgtcttctgaacacaccatgcccagcaggtgtgagcaaaggctgggatatggtatggtataaaaggtggggatgggattttgtttgtagttttatataattttaaatgtttatgtgttgataattatgctttgccacctaagcttttggcattcaggcccatgcttcatttctattttttaatccctagtaataagataatgtcatattcatagtagatctgaagtacttggcatctcttgaataaaccataagttttgtggtatattggcactaattatgcatcgtttttccttcccccattcagtgatgcgatagctgaaattcgagctatttgcattgaagagattggcatttggatgaagatgtatagtgatgcctttcttaatgacagttatttaaaatatgttggttggactatgcatgataaggtaagatgtgcccttcagactgcttctttctacacatcggcgtggctgtctgcacctctcattcatgagttatctcccagtatgtatacctggtgacacatttctggaagcctcccctttattcttttctatcttctctgtaaaaacttattttctatcacataaagtctgctagatatttttgaatcctggccactgatttaaccattaatggtgaatcatttttttgctgaaatattacagtcatgaaggtagtaggagtgaggcatttcttagggcacgaagaagaaccattacgctgttgttatctgagagctatatacttaaaaaaaaaattattcaattttgatcctctcttttgacaaacctgtatcttagccagattataccttactacttggtttctgacctttttaatatgttttcattaaactaccattctcttaggctgcctcttcacttgccttgaagaaattgattgtatataattctttccaaacattacttcccatagtggaaaatatactgtgacacatgcttctattgtttttcacaatagatttgttctgaacaaattttcaaaaattatcctttgaactacagaaatagtaaccccataggtatttagtcataaatgtatgtactgattactatttttgcattatcaaacatgatagtttctgaaggaatgctatggtatgaaacatttaaaattttaaagtagaaaatattgtgtacatcttgaatattgaagttgaaaatacatagagttttaatgcattgtctcatctttttttttttttttttttagcaaggtgaagtaagactcaaatgtcttactgctctacaagggctttattataacaaagagcttaattccaaactggaactttttaccagtcggttcaaggttagtattacttaagaatttacaaataacttgtcatttgcaaacacttttctcttgctttccttttaaaaatattttaatttttttgtccttaggatagaattgtgtctatgacccttgacaaagaatatgatgttgcagtacaagcaataaaattactcactcttgttttacagtaagtatgtatttgttgcatatttgcactaatgttcagatatctaaataatatattagagtatttggttcagactcatctaggtctaaattttagtagcttacgtcatggaggtttacagctagaagttgaatttcttcatgtatagttgagaaaacacaggaagaaggaaccatagaatatggaaattcttttttttttcttttttttttctgagacggagtctcactctgtcccccaggctggagtgcagtggtacgatctcagctcactgcaagctccacctcccaggttcacgccattctcctgcctcagcctcccgagtagctgggactacaggcgcccgccacgacgcctggcttattttttgtatttttagtagagacggggtttcactgtgttagccaggatggtctcgatctcctgacctcgtgatccgcccgccttggcctcccaaggtgctgggattacaggcgtgagccactgcgcctgaccgaatatggaaattctaactgagctaggaattcatgtgttcccattctcttggcagattgatttccttcctgtttttctgtttttgatgctcttgaaataagcacatcagtgtattaaaaaacatgcttattgtattttgttacacttttagagtatgagcatttataagaatgtctgttatacttctcatagcacctttaaacaatctgaatttaagacctattctgtgttaatatctgatagtgatgttattcatatttttcctttttaaaaaatggtagtaaaatatagattatgtaaaattcaccattttaaccattttaaagtatggtttactgtcattacctatatttacgttgttgtacaactgccaccactatccattgtcagaaccttttcatcactttattctggagctctgtacccattaaacactgattcttcattgtcccctttccccagatcctggtaaccactgttttattttctatctctatgaacttgcctattctagatatttcgtataagtgg

SEQ ID NO: 138885 - DNA, 1055 bp, Homo sapiens
gttcacagaaaacaaagattgttatataatggctttcaaagagactcttttgagccatatagattaaacttttcttgttcctatgatgttattaaaatgcctgttgggggtgcagcaattattaggaagagtaggtggtataaaacatttacactacagttttctattcattgctgtttagtgttaattctctttgttgtttatgaggaaaaatgctcatgctatccatagtaaaaggacagtaagttggggtaattttgccagaaggatggaaggaaagtatatgtttagttttcaagatgaatatgtatcatagattttttagcataaatggtgtagctttgtcaatgtactacttttatggaaggcaacagttatataaaatacagtaaggtttttaaaaacaaatagtttataactcagtacaattaacttgagaaattagtttaaaaggacttagaattaccatcaaacatgaaatgaaaaaggtttatagcaattatttgcgtggtgtgccatgttggatgatattgtacctacccagttctcctttactcctttgttagatccttagatatgaaattgaaacagttaatttttttattagaaaattttttgttgttgttgtcgtaaaataaatattttacttttttcacaggctcttcagtcgtagagatccagaggaggatggaatgatgaaaagaagaggaagacaaggtccaaatgccaaccttgttaagacattggtttttttctttctagaaagtgaggttagttgatagtatttattttatacttaggttcgaaaaattttggaaaaggggttaaaatgaggcacatttaaaaaaatattccttgtagcacagtaaattgtgaatagaatggagagccacccactcccccactcccccaatttttttttttaaatatgctttctacttttcttctttttttttttttttttttttgagacggagtcttgctctgtcacccaggctggaatacagtggcgccatcttggctcactgcagcctctgcctcccaggttcaagcag

SEQ ID NO: 138886 - DNA, 1032 bp, Homo sapiens
aatacataaattagccgggcgtggtggtgcatgcctgtagtcctagctacatgggaggctgaggcaggtgaatcatttgaacctgggaggcagaggttgcagtgagccgagatagcaccacttcccaacagcctgggcgagagcgagactccatctccgccacccccccaaatatatataatttattataaatatatatattttatataaaaataataaaaaatttttttcatattaatgttttaatgataattgttaatgtgtaatgatgctacctaacacgtctttcttacagcaagcaaactaaggcagtttcttctctgtcctttcatctatttgacgtcaaaaaatagattgctgtttgagagtttgtagatgatgtcaataaagtttccattcttttgagttaaggctagtatgataattgtctaagaccacattgctctttttaaattttagttacatgagcatgcagcataccttgtggatagcatgtgggactgtgctactgagctgctgaaagactgggaatgtatgaatagcttgttactggaagagccacttagtggagaggaaggtaaggatgtttaattatgatatttttgtttagacagttttgtaagtagatttttactcattccatttatttgtccttttagttttaagacaatttgatagaaaaatcttacttcgtgcatagttttgttttcatataaatattatgctatgtaaaaagatgtaattgctgtcaacattctttatttttttgtatctgggttattttttttacccaaatgtatggatctgtggtggatagatttgggatgctgagggttttaggaaggtgatgttttctgtgataaagtaatgggattttctttagtaccttagggcagattctgtttacaggcagaagaaactgttatgtaataattacaagtggcatatagggagaagaaataagctaactctttctgactttttttttttttttttttttttttagcactaacagataggcaagagagtgct

SEQ ID NO: 138887 - DNA, 2521 bp, Homo sapiens
ttagaggtaaattttaaagcattagcaatttgagaaatttgagttctctgtaatatacttttttagttgctgcaggagatatgattgacagtccctgccttcatgactgaatgtagcatacaccatttggaatggtgcagttgtatgttttatttatggatttgctttctatttcttctaaaataaaatcagaaataaaaatggagataattttttattaaaatagggaaatttctatttcctggaatcagattttaatgcattattgtaaagtttacatgaacttgcattttataccaacaattccacaggctttcaaacttttgactgtaaagcataaaaattcattcttatattgtgacgtattacacatgaatatgtttgtgtgtgcataactgaaacaaaattttatcaaagacaatgtgatgctttctgtgttttctatttctgttttttaaaaatttctgtttcttttttgctaattgctgatagcaatttagtgttttgaatttgttacttatgtgtcatgtcccacagcctagagtaagcagaaatgctggtcaatcccagtattttatatataagctcttaaactatatttcctatttttaactgattctcctaccatctgaaggtagagttggttagtcttattggatattgattttccctataggactatccaaatttttttttgttatttcaggtggctttttgtttttataatgtgtagttttctctttcatgtcacttttagggttaatgttttatagtgaaatttttgtgtccatctcttaaaatatagttttagtaatcattttgtatgttttaactaaaacttgaacacttaacagtgctaatgggcttaataaatacagaagtctttctgttcctttaggtgcttacagcaaaggagaagaagacacagttggatgataggacaaaaatcactgagctttttgccgtggcccttcctcagttattagcaaaagtaagtttgtgtcaatatcatagtgttactaagaaatgagttttttttccctaaatgcctcacagaatattataatgctttcttattgtgatatttttaacgtgatctttatatttcacagtactctgtagatgcagaaaaggtgactaacttgttgcagttgcctcagtactttgatttggaaatatataccactggacgattagaaaaggtaagattattttgtgtaaaaaaaacctttaagaaaaattattcagttcattatatcatagcgtttgtttatatttcttaaaatgtttttttggaacgtattttaagaaaggaaacctatagcttaggtcttctgtactttagtttgacttacagaatggcggtaatgatgcttccctttgcttcatgcccacaactgtaccttcattcttagctattatatgactatgtcactgatcatttatagagactgggggtggataactagataataacaattagatgagattgggctcattcagggtggtatggccatagacgataataacaattataagacaaaatcaactaatatttattgaacacttttgctatgttctgtggattaatgtaagctcttagtatatgttagcattctcaccatagccctatgaggtaggtaatatctcccttaaagttgaggaaaaagtatggatggatcagtgtatttatttatcatgattagaaaagcaccttaaaatgtacgctctgtgttgtagacttactgtatttgaaaattttttccatggtggtatggtcatgtagtcactttatacctatcatatatgccttagttttgatgaaaaatattattattttgcagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagaggtatatattataactattacaagtattttgtcagttgagcccctctactgcagtaagctaattagtcacccaagtgttaagtcttggtgatagtccctagcagtattttgaaaagatgttcaggcttttcattctatgactcatcaggctactcctccaccaaaataggaaagtggtaagaatctgtgactcagagaaggtgaaagcaaaactaacatcttttttgttttgagaaatgatctgaacagttacctggtttttattgaaccagggctgttaaggaatagggtgttaatggaacagaaaaggagagctagatttagactaggtagcctaaaaaaagtagagtatttctaagtgttttggcagtgtaggttagggaaggacattatgttttttttttttttttggagacggagtctttctctgttgcccaggctggagcgcagtggtacgatctcggctcactgcag

SEQ ID NO: 138888 - DNA, 1046 bp, Homo sapiens
tgtgatctctattctaatacttatctctttaatgttttttcttctgtagagtgaagagtggtaccaagtttatacattatttcatatttgagaatgaataccttggggcattgcaatatagagcaaagtaggggatttggagttagaaaacatgagtttgagtcctgaccctgcatatttttgtagtgtgtaacatattgtacaagtcacttaatgttgctgaaaattaaaaaaaatttgtgaaattactttgcagttagtaaagccttatacaaatataagcattcgttgttacataaattatacttcgcagctttagaatcttaggaaaatactaaacattgatttctcttaagatttttaaatatagaaagttggattctgtttctgtgttaaatatgtaaattatttgtggcagttagtgagaaaccttggattatagcatgctttcctcttttttttttttttaaataggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcaggtaattttattgccatctttttattaaatctgtgtccaccataaaatcaaacttaagtaacaatgatgtacatcggtgcactaaaatatattttatccttaaaaacgtgaaacacaggtatatattccagcacaatttatgttcatttttttgtactattgtaaagaaaacgtgatgttgcagagtataggctttcaagtcagatcgctgcttctcactagcactgagtctgctttctaatttctaactacctcataaaactgttaaaaattgagtcaaatgactagtacagtgcctggacatatagcaggtactcaataaaatttattccctcttgcccttattcattggtaataccaatatgcagataatttggaaagaataaagtatttatgtg

SEQ ID NO: 138889 - DNA, 1077 bp, Homo sapiens
tgtttgtgtgtgtgtgtgtgtattgttttaaagaaagtaacagtgacataaaatgtcagtatatctgcacattctcacactttacaacctgcttattttctattcctcaaattaaaagcttggcaaaggaagtagtgagtgaaatttcctaagttattgacttttttattatagtccctcaaatatttatttcaattattttttgttttcctttgcagagatggcatagaatttgcttttaaagagcctaatccgcaaggggagagccatccacctttaaatttggcatttcttgatattctgagtgaattttcttctaaactacttcgacaagacaaaagaacagtgtatgtatttgctggaaatgtcctatttaatttcattttgggattcttaagggcaatttttatacttggtttctctcctttctactcacacagaattgtaggattgcattaatacacaaaaaagtttatacttcagcaactttataatttaaggattataactgtgttttatgcataatactctattttaatattgtgagttttcctccagtataattttggcttttgacacgtaatttgaatactttatgtattatttaagagactggactcactatgttgcccagactggctttgaactcctgggctccagtgattttcctgccttaatctgagtagctgggactgtaggcaggaaccactgcctggctgctttttgtgttattatctgcatttgtgccttaacccaactaaggagggagcatttgaaaaagaataataaaggcaatccatcaggaacatcctttaattctcaaacagggcacttttctggtttagtctccaataatagtgacttataaaagagcccccaaaatggatttaaattctcaaaaatcttctacctttcgccatggctttgaggtgtaaaagggcagaagcgtatggatacctcatattgtaaataatcttgtctgaaaactcactagtattttgcatttaaagactatagattttatatgaaattctaaagcaggcaaaactaatgtatggtgataaaaattacagtaac

SEQ ID NO: 138890 - DNA, 1077 bp, Homo sapiens
ctagaataaaaatcttaccatgtaactcttacttaaaacctttctgtggctccccattgcctgctggataaactcccaacttccttagctcatggcatgcaagatgtttcaaaatatggcccctgccacgttttagtatcatttcctattccctggcagctggtaaaatcatcataaaagaacaagctcaggtgtcactttaactgaagctttggtcatctatgctcccataacactatgtatatccatatttcttatagcacttgccacattgtattgtaaatatttgtttatgagtttgtcccgtttgtctagactgtgagctcctcaagggcagggaccacattcattgcctatcagtgcttggcacgtaaaaggtgctaagtaaatgttcattgaatgaataaatgttcaatgctaaaaaaatgaagtttatcttttaaatactttgtttttactggattatgtatgataactttataaatctttctaaaatcttcattagctttggctctaaaaaacatggcagacaagcagtctttagataatttttttaaatgtcttgattggtatacagggaaaagtgtgatgattatgattaagtttttgagtttgaaagcattgtatttataatgtggtatatgttttactattgggagatagtagttgttaccctcttctttttttaatttatattttgttctgtcttgttggtttttagatgttaagaattttacctgtttttcttacaaaatgatcatttactatgagtggtggcctgcataaattcactttagttatctccatagtggtcttaacctctagagacacaaggtatactctattacacgtatagattctgatcctggttaatatggtcatcatctatattgtcacatagttctatccccttttgtctgtttctgtgaccacattccttttaatataagttcttattttatgctggatcctacaactgatttcttggcttccaagtagtcgccggtccatatattccagaattctgccatgcaatcatttggtctatatctctccccataaaacattacaccagtt

SEQ ID NO: 138891 - DNA, 1399 bp, Homo sapiens
ttctaaatatgtcttagttttgagtttcatagggcacacgaatctgaagtttcagcatgagtgttcctcatttcttcctgaggcagaattaattccttattttagtatgtccttataacacttgatgcatagttttcttgtaatatttatcacattttgtcataattaattgtttatctctgtttgccatggtagactgtaagctccttgagggcaggaatcatgtcttagtcttattcatcttttttttttttttttttttaacatccataggacacagtagaagcctgtcacgtagtaggcattgtgtgagtgagtgcgcgcatgcctggtacacattaggtactgaatgaatgagggagtgatgatgggtaaaattagcattatatattgatgaaaatatatgttttctgaaaatgtcatttttttggtctctgttttatgtttgtttattaatttgtaccctgcctactttcaaaaaggatttgaggtatcttgtatgttcccatgtgggaaattctcattgaaccttgtatatgggatatcagaactataaagctaaatgtactgaagtaatgtagaataaacataactccttagcatttttagacaagtaaacattgggttttgatatcattgatgacataatcaatgcctaatcattctccctgacctttaattccatcattttccattatacttgaatatagagagccacatactgctgcctagatattaatagtcacgacattagttcagatcttgactttgttttatatttctctagtcggcgtggcacaagcctaatggaagatgatgaagagccaattgtggaagatgttatgatgtcctcagaagggaggattgaggatcttaatgagggaatggattttgacaccatggatatagatttggtaagaaacttaatgatttctgtaagattttcagtttagatcttttgaaaattatgttggatatttattagagtagagaaatacttaccaagagaagtaagttttgcaaaaatattaaaatagttgccaggggtttagatatatgggaagggatttagaagagagtaaggttggtgaaggtggtagatcctagattaagatgataacaattgtctgtttgtttctgagattaatttaggaatatataggtttaaagggtatattttgattaatactaatttgactatgaaaatcaatttttatttaattatgcattttaaaaaatatgagttagtataaaagtataccattatcaaaacaatatattaatactacttgttgagacaaattccgtatcagataatgaagtaaaattacttaaacttggaaggaaattaaatacaggtaggagtgtattctttattaataattaaatatgtggttag

SEQ ID NO: 138892 - DNA, 1047 bp, Homo sapiens
taaagtaaaatgaaaagtgagttttccggtttttgtctcttaggataattttccatgagttttttttttgagatggagtcttgctctgttgcccagacttcagtgcagtggcacaatctcagctcactgcaagctccacctcctgggttcacgccattctcctccctcagcctcccgagtagctgggactgcaggcgcccgcaaccacgcccggataattttttgtatttttagtagaggccgggtttcaccgtgttagccaggatggtctcgatctcctgacctcgtgatccacccgcctcggcctcccaaagtgctgggattacaggcgtgagccaccgcacccggctgataattttccatgagtttttaaaatattgtgtcaggtacacttggaatcacatagaccatgtgaagaacttggatattttcagttactatctggtttgtagatatagctaaactaatgtcaacttatttccttttttcctttagccaccatcaaagaacagacgagagagaacagaactgaagcctgatttctttgatccagcttcaattatggatgaatcagtaggtttaatttaaatgtaccctaggattgcaaaatcagaagtataggcagtctctcagtttgaggttgaagacctggggcagcatactgagaatagatgaaaacagctggatgtgagaaaaagaggcaggcaggcaggatttcagtgggaggggaagagagtgctgcaatagtgttgacagattagaaaagtacttttgaatcctggctgactgggacttgaatattaaggaatttggactgttcttccaggtttgtactgttcttcaatgggttgcccattgaaagattttaaataaggtaatggcatgatcagaattgtgtttcagaaagatttccttgacatttatggatgggacaggatgaatgaggggcgtcatataaaggcatggtgaaaaataatgagaacttgaacaaaggctttgataatgaagagaagggtatctagctatctaggatgagagtcagttacc

SEQ ID NO: 138893 - DNA, 1053 bp, Homo sapiens
aattctagctcctcagcctagcaaacaaagccttttatgatctggttcccttgccatcttaaccttggccttttccttacatgtattctatgctctagccatatcaaatcttgtagttccactcagatacactatgctctttcctgactccataactttgtataagcttttttctgccagaaattcccctttatttttcctcctagtaaagtctttctttgatactaattctgacattacctgtggaatttttgctgacttccacagatttttttttctctccttctttaactgtttgtacacactttattgtaataattaccagacttgtgtagtgagataggatattacatgccctggtccttcactagactgaactccctgaggcagtgatgatgttattcattcttagttctgcccagcacaatagatatttagttttgtcaaatgaataaatcatttaaatgccctgccatctccctttttagaatctacccattttatgttccttgttcctcacacctactgcctcaggtgacggttataccatcctcaaaggcctgccttctatgtacaatttctaccattcccaccttgccctctcctacctcataatctgctttcagatagcttttagaactattttgacaaactaattcacactaacatgtttactaataaggccaaggggccgggctcagtggctcatgcctgtaatcccaatactttggaaggccaaggtgggaggattgtttgagcccaagagcttgagaccagcttgggcaacacagtgagaccccatctttacaaaaactaaaaaaattagctgggcatgaagatgcatacctgcggtcccagctactcaggagggcgaggtgggaggattgcttgagcccaggaggttgaggctgcagtgagctgtgttcacaatactgcactccagcctgggtgacagagccgagaccctgtctcaaaaaaaaaaaaaaaaaaaaaaaaagtagaatctgcttcaattggtcttaagtgtggcctgagattctgcactgctaacaa

SEQ ID NO: 138894 - DNA, 1021 bp, Homo sapiens
tgctaggtatgatttattttgatcctctcagcaaccgtgtgagaaaggtaatgggaatttccactttcataccatagcaagctgagactgaagagatcatttagtgactttgctcagttatacagttagcaagtgtccgagtagtaatttgatgccagttccttttgatttaataatctcatgctgtcttctactgttgtgcttcccaaaactaaaatccccatttggatgagaacaccaacaaaagtaattaagaaatcgaaatggttaactgtgatcaaaattaatatgggcagttaggatcaccattttttaatgtatttgtctaatgtcaggagaacttttaacattcgttttcttagttacatactagatttgcaaaaaggtgttcttcagattactaaaataatgaaacagcaatattaactatgtgtatctatttttgacatttaacatttagagaaaaataggggcctaatagtcattttttatttatagtgattttatagcattctcatgtatattgaatgttacaactgaggggcttttatttattcttaatttgataatagtttagctgcttctgctacaaaaattaggaaaattagcacatgtacttataactgtagttttatagcattaccacatgatggcagcagtcacataactgaatgctcagtaatctttaaaggcttaggtgtctttagaagtctttgaccatgtaattttttttttaaagttaacagtttattttttaaatatacactaaactatactccatactgtcttaaccataacttaagaaatggaataatggaaaattttgaatgtcaaattctgtttgcctttatacaataccccacatctgttcttactgaagcccataataccggagtcatctaaacagtagcaaaattgggatttaaattctttaatgtccagttctgagattctccaattctaagggaagtaactcaaagcaccctaatgtagacacttcagtttgttactaaataaattg

SEQ ID NO: 138895 - DNA, 2870 bp, Homo sapiens
tctgcatactcaaatgcctttttgaaaaaccatatccacttcccagcacaaatagccaagtttgcaagactttcttaacccctttccaaggaacctgtgccagaaatatatgtgaagaagcacattcatttattcatttaacaaatacctatgttgagtgcctatgtttagggtattatctagacattagtggtacatataagcataattaatccaaggttcctactttaattatatgtgaggtaagtagcatcttgattagtcctgatgttatttcattatatatcatggtcaatttaattttagaattatacatctgaagagaggggaagttttcaaagtggttttattagcatgttatttaacataataaagtattaatgtaatatttatggatatatttaaagaaatgaatgacttttaacgagattttctcccctctctctctctcattaggttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatatatatatataaattggtgctgattttataattgcgcagtttgtttagttttttcttacttttaaattccaacttaaaattatgaggtttcagaaatatattgaaagtttaacaatgtttaaaaatagaaaagcatgagtgttcatgctttaaaatgatttttaaatttgtattttatattgttttatctatctgtctttgcaagcagtcttcaggttaaagatacttctaacaggttacagtacatttcctctgtatgtaaattagatgggataatagaattcataacccataatattctttgaaagctaagctttaaacttcattttatgtcctttcacaaataaattagtttaaaacagaaagtggctacttgccattttgacatcaactcattttgcgaggcttaggcagctagacatcgtttaaaacaaaatattaacttatattacatgtgtatctatctattgtcagtcgtctctcagttcttgaggtatattattttaatcattccatgccttaatatgcttgcaatacaagaatatcttcagatgggtgaataccaaaaggctttcagtttttagtcagaaatcaagcattgggctgtggtagccaaaaaccataggttagctaaaaagatcatgatacaattattttattaagtcatggttaataacaaatgaatccagacttgtctaacagattttccatcaacaaatattgttatgtgcaaaagtattgcctatgttgttttacacaccactgcattaactagaactgctgagaggactgtatatatgattttaaacctaagttgattttttttctcactcttgaaaggagtacttctttgtgaaagcagttcttacagctttgttttcaaccagctaaaaatgttttatatattactctaacctgttgtcctccacattctattgtcctaattgtactgttttctgatttgtatttatgtcttgagacagtaactttttgaataaaaataaacctacagtatgttgtatgttttctcttgtactcaaagggggagggtggctataaatggtttgcaaatttatatctattatcacatcttttaatgtgtttggggaataatttatagagaataccatcagtttatatttttaataaatcatatgtatttacaatgaaaccaaatccctaattggattattactttaaaataggaacctgtaaccattattgctttaattttcatctggtatgagttaaacacatttacaaatgtttacattgtttatacagggtacatttgagtgcctactgtgtgctagcatgtgttaagagatctctccttcatagatccattggggaaaacaaaataatgaaacttgtaataaatgccaggaaggaaacaagcaggatatgctgaggtagagaatgagagagagacagtaagagagaaacctgccttaaataaggggctcatggcatggaggtaaaaccatttgaaaaagaattta

SEQ ID NO: 138896 - DNA, 1057 bp, Homo sapiens
aatcagctgggtgtggtggtgcacgcctgtaatcccagctactcaggaggctgaggcaggagaatctcttgaacccgggaggcagaggttgcagtgagccaagatgacaccactgcactccagcctgagtgacagagtgagactccatctcaaaaaaaaaaaaaaaaaaatctacgaattgccacctgtatcttagcattcattgcatgtatgcatctagtcaaattccggaagccgatttgcctagctcatctacagttgaccatagacgcatgaaggagcccagctaagactggaagaactgcccagctgagcccgaattaaactcacaacctgcagaattgttagccaaataaatggtgctttattaaaaccactaagtttttgggtggtttttaaaataacatagcaatagctaactgctactgtaagcaaagtacaacaaagcattaatccattgtgctgtgattttaaaaaagatttctggttgattttgcatttccaagggtacaatgaacaaagttttaaaagtagcatagctaatagtattgctaatcatttttgtgcacagtagaatataattcagacaaaacatttttcagtaatttaatttttagaaggaattttgtacctgagattcatagcttgggcacatttcaaaaatccttcaatttcaactactgaaaattgttggcagtctataagcatcatttcaacaagttttgtttagattcttaaactccatagactcaacacaataaggaattgccttaaaggattcctgtaaagtctgtttttttgaagcttgcttaatgagaatcaaatgagctttggttaccttacttgtctctaacactttcttgtctttatagtcattacgttctttgttactatatttggatgaaacatgatttatcatggctgttgcaagtgattttggatttttttcctcatgaacttctgaggcagaaaagttgacatttagcttttattttgtcttcataactatgaaggattttcaaataagactttttcttaaaacactcatggccttata

SEQ ID NO: 138897 - DNA, 1267 bp, Homo sapiens
gacagatgttctttatgtgccaggacctctgagtccctgggcccagggcatgcaaccccctctgccagtgccacatccattcccacacccaccaccattcccaatgaaattcccatccttgccacctctaccacctgctgtagtcacgggggcagaagcagcagcagtcccacttcagatgcctcctactgagatccacccaccttgcccgtggcctgcagtgggcttccaggaggagatggcccctctgtggtaccagagaagctacatccaggaggaagattccaaaatccttcaggggtcattccccttaggagacagcagaagccacagccagggagaaggttcagagaggtcccaaagaatgcccctccccggggacagtgggtgccacaacccgctgtcagagagtccccaggggacagccccactggggagcagcggatgccactcccaggaagaaggtacagaaggaccccaggggatggatcccctggggaacagagagagacaaaatcagaaagaaggtccaaagagggcccggaggatgcacaccctggtgtttcgcaggagccacaaatcagaaggtccagaggggccccaggggacggtcccccagggagacagcagaagctacagccaggaaggatgttcagatagggcccaggagatggccaccctggtgtttatcaggaggtgcaaaccagaaggtccaaagaggccccagtggactgtccccctgggggacagcagaagtcatatcaaggaagaaggcccagaggggccccagaggattgtcctccagggagacaacaggagctatagccaggaaggaagcccagagagggcccaggggatggccaccctggtgtttagcaggagctgcaaaccagaagaaggtccagagaggccccaggacactcccctgggggacagcagaagtcatatcaaggaagaaggcccagaggggccccagaggattgtcctccagggagacaacaggagctatagccaggaaggaagcccagagagggcccaggggatggccaccctggtgtttagcaggagctgcaaaccagaagaaggtccagagaggccccaggacactcccctgggggacagcagaagtcatatcaaggaagaaggcccagaggggccccagaggattgtcctccagggagacaacagaagctatagccaggaaggaagccgagagagggcccaggggatggccaccctggtgtttagcaggagctgcaaaccagaa

SEQ ID NO: 138898 - DNA, 1027 bp, Homo sapiens
ggctaaacaggactgggaccaaaattctctaaagctttcttaatgatccatgaacaattttggattggagctttagagatttaaaccttatgaatacttaataatgtataatttgctcttttataaaaccagcctaaatttcaaatacctccttgacacccccagaagcaaaaataaatacaactatacctcagcactccaagaacctgtttctgtctgggacactcggtatgtataaatgtaaccgtgatacctgtgaaagaataaacttccattactgaaagattccaaaagaacaatggatactttaaatttgagcttaatattacatataaatgtcacatatactaggacacacgtatatggtgtcattgcattcataggaagtaaagcatagtgaatctaacttgtctccatattgtatctgcccaaccacagtttccagtgagatttctttatcttttcattttttgaaatatggaaattcatgctcctaaagatttgtcaagttgagagaccatttggacagaaagaaactacaacagggacctgttgtaattgataaaaccatgaattattagatagttttaacaaacaatagacttatttttaagtacatatcgaaacttaaggtgaaaacatttcactgggataatacactatcaggcccacataaataattattaatattaataatatttgttataaatataatggcaatagtataaggatataatactataaattgaatataactatatttttataaaattactattataatgtatagcaatataatattgccacagtcatgcatcacttaccaagggggatacattatgagaagtgcatcattaggtgatttcgttgttgtgcaaacatcatagactgtacttacacaaacctatatggtataccacctaggctatgtggtatagcctattactccaggctacaaacctgtacagcatgttactgtacagaatactgtatgcaattgtaacataatggtatttgtgtatctaaa

SEQ ID NO: 138899 - DNA, 1042 bp, Homo sapiens
gacatggttcagaagaagtgtttgaaccctagcaatagacaaattgtaacaaaaaggcaggtaagaatttagttctcctctaaattacattaccatttctttttctccgctgttttttacctctctgcccaatgctatgaccagtattcagtgacttcctgttactgttaatagacttctactttacttggttaattgtagtcttatcaaaataattgtgaaaaattcaaaggtacattttggaactattcatagtgagccctgcggggcgggggggaaagcataatcttcaaggtgaactttagtgtgctttaagcacattcctctccagtggggaggatttcaaaacttttgtcgtttctgtaggcaatgaggtggatatattagaagcgtgaaagacaggttgaaagtgatcagttaggaaaatgttgcaataatctagagaaagagatgattaggagcttaacttaggcattaaatatccaaattttctaaaagggagacatacataggagataaatttaaattggcaagacttaggggctaactggttgtaagcaatgaaagagagaaaataataaagatttctgaaaaaaactggtttggctgtgtccccacccaaatctcatcttgaattgtagctcccataatttctacatgtcatgagagggacccagtgagagaaaattgaatcatgggggcagtttctcccgtactattctcatggcagtgaataagtctcaagagatctgttggttttataagaggaaaaccctttcacttggctctcattctcttttgcctgctgccatgtaagacatgccttttgccttccaccatgattgtgaggcctccccagccacgtggaactgtgagtccactaaacctctttttccttataaattacccagtcttgggtatgtctttatcagcagcttgaaaatgaactaatacaatttctatctttggcaagtcattaaagaggaggatggtgctagcaatcaacaaaggaaggtagggaagcaagaaggcagagttttag

SEQ ID NO: 138900 - DNA, 1044 bp, Homo sapiens
gactgacttggctacaactgggtcgggtacaccctgtggctaaagggtgaggtcatgtgatataaaacttggcagcaagagcagcagaggttgcaagcaggcagtggactaacaggcagtaattgacatcttcatatagtctgtttcttgcccattagtacactaacctttctcctatatacaatactaaagatgtctctgcctaaaaccacctacctattacacctcaaccacaaacacgtgcttccaggagagacacaactcagtttcatctagaagccatatgaaaggatcatattaaaagctgcctgtcagtctctgtctgcaacctttaggggacatccttaaatttttcagttcctgggcctgcttatggtctttggttcagagtatatattgcatccttgcagctgcttgggaatgatgaattatatactgaaaccagtaagcataaactattgcagaggagttctttcatcagcaaatctgaccaactggggaatctgcctctgggaggattatccctgagatgatctaagggcagcaacagtccacttctaggtaatgttggtactctgggaaaagccaacttgaggggttggttctcaaactcgaacttggattggaatcacttggaagacttgttaaaactcaaactggtctatggccataccaccctgaacgtgcccaatcttgcctgatcttggaagctaagcagggttgggcctggttagtacttggatggaagaccccctgggaatacgggtgctgtaggcattatttaaatttaatttaaaaaaaatccagaatgctgagctccatctccagagcttctgattcagtaggtacttgcatttctaacaagttcccaggtgacgctgatgcttttggtccaggaatcacactttgaaaactgctgtttctagggtgccaatttgaatccaggcgtttggtggttgagctgaagtgggctttgttgtatcgctgtatggtagtttcagtccaggagaatttcactaggtcatctgacagttgtgatcctta

SEQ ID NO: 138901 - DNA, 1052 bp, Homo sapiens
gtatctgatttggcccagccatataaatggattttattgtatttattgttccatatatcacagaaatagtaaaagataagtaagtttacttcatgtactgaaaagaagtatatataatacattttcctccctcataggctccacggcctccaaaacagccaaatgttcaggattttcaatttttcccaccacgcttatttgagctcctggaaaaggaaattctttattatcggaagacaataggctataaggtattttttccattttttaagattaatataatataatctttaaaaataatttaatctgttaatctagactagaaggtgttgcattttaatttgagagaatgtgacagcaaatcacaacagtgatgtttttaaaaccaaagaggaagtttaactagatgtaaaacatctaaccactgaatcaccagtacagtcatcactaaatgagattaatgaagaattatgcaatattttgaaatagtaataacattatttttataatgccagtgtttgaatagttaaagaatatgtagagagaacaataggtatgcggttaaaagcgaatgttaatatatgataggaaatttttgatcatttccttaataggtccaagaaatagtatttctgtctttattgcctatacgttgctgaaagccttgctggtggttagtagattgtagtcacttaggtgttaaagataatgataaacatgatagtgaattatacaattttaaaatgatcttttggtatttggaattcttatttatataggtagatagaatcctagttttcatgagtgaaatttaatatttgtcacactaaatctgtcatattgggagagtaagcataccaggtaatttctgtatgttgaaattgacttcctagtgaatggagagagatgaccaaaggtataataatcactaacattaaaaaattataaaatactggccgggtgcagtggctcatgcctgtaatcccagcactttgggaggccgaggcagaaggatcagttgaggtcaggagtatgagaccagccttgccaac

SEQ ID NO: 138902 - DNA, 1072 bp, Homo sapiens
cctcattcccatttgtaaaccattttctctgttggttgatcttctaaactaatcattcataagctaatggaaatgaagttgagatttctgatattttacctcctagatatatttcagctctcactcaaaacgttttcattattattgtttttaaataatgtaaatgaattattacttgcttagttaaatttgtgtatgtaattgttctaaatttgtatctatcgatgtaagcttttaaagattaggaacttcatttatataatatactttctacagaaattcacacagtacagtatatgtatagatgcttacatatttttgaagatggaagaatattataaagtatatttataaggaatattataaagtgtgtgaagattttctatatgtattttaaatgtttttatttgtttcttaaggaccctgatggtctaattttatttttctctttttcttctatccctttatcaataaaaaataaaggaagcaatagaggcttttaatgctcctaatagtagcaaattcatctttatgctaagtaccagggctggaggtctcggaattaacctggcaagtgctgatgtggttatactatatgattcagactggaacccacaggttgatctacaagctatggttagtaatctttaatggtgtcagaaatttatcatagctctgaatactattgctatttacacacataaaggtcatttatgataaaaaggtaacaatttttgagagattttatagaagttacagtagattatcctggaaaacacagttgctatgctaattgcaaaaacaaaagaaatgaaagcgaacaacaaacacaccccagatccaacttatagcatttatgtgttgattttggtttttttcatgaaatagaaatgtcagttttttcccattcctacagattgaagaggacacataaatttgttttaatgaaaaggattaaaaaacaatctcttgttattattctgttcaacaactaaatatattaaaatccttagtactgaaattaagagaggtaggattttaactttcataaaaaacaatttgggagagaagg

SEQ ID NO: 138903 - DNA, 1010 bp, Homo sapiens
ctgacctcaagtggtctgcccacctcagcctcccaaagtgctgggattacaggtgtgagccaccgtacctggccccattatgactgttaattgataataaaaagtagcaagtttggccataagttgctttgcacactttatcttgcttttgtttgttttattgtttggtaaaattaacattcttattagcattatgtctttgattttatattctacttttcaaactagatataatattgctacagtatggggaagcctaataaatgtcttttaaggaaaaagttgatggaattcttacacagtggggctcaaattttgttaactgctccagtattttacctattttcagaagtaaataatagtagctatcacagctgataatatttttgaaagtactttttaaatgcattatttccgtattggttgtataagaatctacagaatatcgggtatatttaaaaaaactgtgcactcattggagaatttccacccctctacaggactttgattcttggtttgacactaaaaattgtcttggtgatcaaaaactcgtggaaagacttcatgcagtaagtaatagcagacaagaacattcagtaattaaatagtatacacaaactgacccagaaaacaaaatgctatggaatctgtttgaacttgtgtttgcctcttggctcaatgtcactgtttctccctcctaacctttctgacagcctctttgttttttttttttttttttttttttttttttttattcctctatgtcctcagcctctctctagaacagcttttttcctttggctctcccctgtgaataatgtggtcctctccaatagagaggctgttcctgctcccacaccccacagttcctcaggatggtatcggtattctcctagttcacccactgccacttctaagctactgcttctccactgtcatgtataaagctcttcctttgaagcctaagctgtcttgcagttttatcctccacccattctgtttcctgttaa

SEQ ID NO: 138904 - DNA, 1156 bp, Homo sapiens
tatgatctgcattcttcttcctttttttttttttttttttttttttgagacggagtttcactccgttgcccagggtggagtgcagtggtgtgatctcagctcactgcaacttccgcctcctggattgaaatgattctcctgcctcagcctcctgagtagctggaattaaaggcgtgcaccaccacgcccagctaatttttttttgtatttttagtagagatggggtttcaccatgttggcaagtctgtctcaaaccccagacctgaggtgatccacctgccttggccacccaaagtgctgggattacaggcatgagccactgcgcctggcttgcattcttttaagtatagaaatgtttagttttgcctcactgcagcattgtcacctgaactagggtatttttccatagaaaattttcaagttatattgtagtcaaaaatatattggttggataaattacagtataactgaatgttgagcattctaataagtaaaataatcctcatatgagtattattttctagctttcagagattgttcgtgagttcaagtcgactaaccgcttgctcctaactggaacacctttgcagaataacctgcatgaactgtgggccttactcaactttttattgcctgatgtctttaattctgcagatgtaagtttaagccatacgttttaagtataactttcttattttcactgacatgtgttttaaaacattatagattgaaatttatggtactttttaatttgtaattttttatctgcatgttttggttttcttaggaaagagttctttaatagagttttaaaatgaggatctttggagaaatagtatgcttcttgtctttgagatcaacttgcctgttcaattttgtctctatcacattactcctaaaacttatgatgtgaggctgagtccatagtagtgcattcaccattttattttcattaagttgaaggggtttgaaacatatttttatatactagtttggcaggtggaagctataaaatgatctttgattattgtaggcattgacatttggtgagtgctaaagagctcagagtatgtgatttgaaagacagcatattgtgtaaatgtgttatttatatatatatatttttatcattaacacaaatttatgctaggacacc

SEQ ID NO: 138905 - DNA, 1097 bp, Homo sapiens
tctcttattgctgttcatttggattgcccgatgtgtagtgtaaataatgccactataagactcttgtaatttagtttttgtgcacctctcagattatttccgtaggattcctagaagtagaattactgggttaaggagtataaacattttaaggttttgatgtatagtattcataaaagttgtctcattaagtgacatatcagataggatacaataaaaaaatagctttaagcagacatttataaaaagaagtatatatcttgctcagagataaaaccgaaagcagttttaagaggccgaaaaaggacttagttccctttcttatgggttaggtatgggttcatagatattgaatatattattttttaaaaagtcctctggagttggtgatctctctcaggttctttctggctgcaaagttctgttttgtggttcctaaggttcttaagagtgtgagatgcaagtacagagccacaagccccttgagacacatagtctgaatatttaatatctgggctgtaataatgttaggaacaataggaaagaaagaccagtatctaagcaggctggcaaaggaagcgggtctttataaaacaaacacacagaaaattcctaacttcagaacaagaagaaaaattatatagtagattgcttgctcctttaggaggaaaatgttctaaatagaaagttgctttgttgagcaacattctgactgcaagttattggtttctgtttgtgctcacggtaagtacaatactgaattggaatgatttggttatcttctttaaaaaaaggtatttggtatttttacttttcattggtagaaacataattgcctttgcgagatagtggacaaagatcttttgttatgttgttcctaacaaaatgtttccttacagaaaaaatgttcatggatttttttccttgtgatgataatgcagggccttgggaaaactttacaaacaattgctttgcttggttacctgaaacactaccgaaatattcctggacctcacatggttttagttccaaagtctactttacacaactggatgaatgaatttaaacgatgggtcccatctctccgtgtcatttgt

SEQ ID NO: 138906 - DNA, 1043 bp, Homo sapiens
tttttcttatgtttaaggtcacattctgttgatttttgacctaagttttcataaataggttgacaaaagccatgatagttttcacgaacaaatttgtgttttctcttatgcaaagtatgtgttaaaactgaaatgctctcatctttggttctggtgggtagatttgtgtttttattattttatttcttggtttcttatagggaaggaggcttattctatatatgtatttatatttgccagtacaggcttgtctttacaaaggatagggtgcatgagataacccccttccccagataatctctatattaagttattgattgatgttagttttcgctaaattacaatttaaaaatatcaaacattaatagttaagtagccttgacaaattgcttctacaagatgtttatgcaatataaatagtttaaagtagttttcttcccagttagagaaaattaacataagccaaaagtttaaaactgtactattatattaagtatatgtgatcacattgcattacataaaaaattaaatattcttataatactatgaaaacaattttaaaaatatcgttttaggaacagaaaccacagtttttttttctgaaagtgtggcgtatttccatgacataaaggagtgtttcttagaattaatatttactttctttgaattatttggtttgtggttgatattagccttttctagattttaaaatctcttatttaatgtttacacattttcttacactataaattaaagaatggatgagaaagctcagtgtcttgccttttgggttttattccaattaatatttctttggcattcacaatttttcagattttttttattggacctcaggtgtacagaactggattaatcataagccttgttttgtgacatgctctcatcattggtccatacatgtcccacattgatttatatatttagttatgtaattactttccgccttcttctaatgagagcattgaccagtttaagaaccttgctttgcaatttggtgacatttattttctttgaaattctag

SEQ ID NO: 138907 - DNA, 1042 bp, Homo sapiens
cattaatacttttatttcccttagttctatctaagtaattacttatcctatcccaggttatcctcttcaaagttaacacatttgaaaatgcaaaaagcaaaagcaacaagcacccccaaaagacaacaaaatagaaatcaaacccttcaaaacaatgacattttaatgtcagaagttggacagtttcattgaaaaattcaccgctgcttatagcttaattaagctagttaatttattcagccagtatttgttgagcatctattaggctgcagacaaaactgaatatgatctggtctttgctttcaaggagctgaaatcagtgaggggaaataaatataaccataatggagtgtgtaagtgttctattagaggggcaaacaaaggcgataaggctgctggttctgcttgggggtactgaggacagtttcatggaggaggtgatatttgagatgaaactcggaaagaaacagagtgttcctgacaaaaaactaaaaacaatacttgaagagtgcttgactttgagaatgctagttgacgttcagaatggctgtttaccagtaggtcgtaccttgattctggaccactaaggataaataataaatgaaaaattaatatttcaggagtacgtatggatttagaagtatggatttcatctggggagtcaggtttactcatgtttatgtagaaataccagcgtaaacttggaaaccagagaagaaacaagggatttgaaggcaatccagttgtgatatctgccaccttgttggtcactgatattttgaccaatccagctggctgagcaccccctcttactcctccatgaacctgaatgcttgtttgaagagacagatccattctttggtaaaaagccatgggaatataattggaaggttaatttatgaattttctaattcattgattccacacacacgagcaactcctgtgtgccaggctttgtgctaggtactagaaattccgtggtgtaaagatagctgtggtccctgcactcatggacttcacatctagctgtcagttcttcact

SEQ ID NO: 138908 - DNA, 1044 bp, Homo sapiens
tttattttagttgatttgctcatagtctttagaacccagtgctataaaaaatccctttaaaaaatattaaacgaaaagggatttaaaaaaatatgttctaagacctaggagtagtgactgagagaagcagttatttagttaggcatgtattcttttggttgtagtgagtggttttctcttccctaatcctactctcttttttttcccctctcagaagcagaagaaactcttttgattgacatagcttctaacagtgagtatctttctgaatgtgcttgatttttactcaacaaatatttacttgaacactcactacatttaagacaccttttggggcacattttttattttaccatcttttcctgtagtctcctgtagcagccatacaaattagcactgtttcccaaaaacatgtaggctaagcctaagaaaaagcaggtggctggtaagaatctttataaaaataaaaaataatgatctacctttctaatgctgaacttccgtgagctaccagtattgttgctgtcagttgaatcattgctgtagaattgataattgtaggaagggctgatgtttaaagcacataaggtttattggtggagtttttttggtcattttttaactgctattacattttaagttttttccctaccctctttttaaattttgtgtgttaagtcataatattttcctttatttgttgtatttttttggaaggctgaagagtcccttaaattgcttgtccaggcattcctttaaaaaaaaaagtttagtcttttatttaagccccatcccctcaaggcatctctttattagagggaacatgatcttcttttcaatgtttccattctctcatttttatctgtttgaagcaaatcatctttgactttctgtgcaaactgttctttgtttatcatctaattgtactattttatggagtggagaaaatgggcactcgatgctactgtgaggttgctatggaaaagagtatctgaccacatgaatctaaatcaaatgggttgccttatctcttggttgagtcct

SEQ ID NO: 138909 - DNA, 1109 bp, Homo sapiens
ctggatcaccacatccaaacagttgatatagatgataactatagggcatcaaaaaaggggagacaatatgttatacacataataaattaaagccctagctaactttgcttctaattctcctagtttccaattggctgtacttgaaccaaaccacttctgagcataggtcattatattgtttttgtatgtttattcaagacatacattttaaacttgaggtaatgagttgtagatgcttcttttcagaatacttcaaaccagtatcactatttttaagttattttgtaaatttaatctgtgcttacggacaaaccatcctacttattttattcccttcatgcttcagatactctgacaatgtgatctggacttgaaatggtaggaatttccagctaaggaatgggagggagggtgattgaggaatttaccttttgctggaatttgaaggtccctgctttgatgtctgagagatagatcagaacgcaggaaagtataattttagtatgtgtcatatccttagatcgggctgctcatggacacggttcatcagccttaggagttctcacttcccttagggttccctctctgcatcaccccttccaccaccgtcatactgactctcttgatcttgtatgtgtgcttcctatattagagatctggaatatttgtgatctggaccttcttctgttaacctgataagttgagaatatgatcccagtaaaacattttatcccatagcagtatatgtatggatttcaattctttttaggtggctgcaaaattcgggttcagggggactggatcagagagcgccgctttgaaatccctgatgaggaacactgtttgaagttcctctcagctgtccttgctgctcagaaaggtaactaaagactcagcgattttctttcttctatttcaacgggagtggaattctgacatgctgatacagaggaaagtggccattggcaaaatacctcaccctttaagccctgatagctgatttttttttcttcaggagtgaacacagggataggttagggaaaaaatctgcccagctttaaggacactaggcaagttttcagaatattcagtgtcatggcaagcacagc

SEQ ID NO: 138910 - DNA, 1017 bp, Homo sapiens
aaaaatggtgctggcccctgcatataaggaatgttgaaagaatggcttttggctatagtaaattctactcagtgaaagacttcccagtttctgaccatgaaccttatctctctagctcagtcacagcttcttgttccagagcaaaaggactcatctagctggtaccagaaattagacactaaggacaaaccttctgttttttcaggtactaaaaagttcctggtttccttgttgctatggtcattgcagagtcagtagattttgtcaggccaaatatggtgatgtagattaaagctgatgtcagacacattctcctgcagagtagttttatcaagtccaggcccactgaccagtgttcactccttatccttcctgtagcatggtagctgttcaggagccagcttagcagggtggtagaaagtacaagctcgagagccagacagcctggatttgaatcccaagtcaagaacttactagttgtacaaccttcatcaagttactcaacaactctgaacttcccttttcctttctgtaatatgggaagatttttaatagtacttacttcttggagtttttgtgatgattaagtgagatcatgatatagtcccttactctcaaccaggcattgtgctcagtcttcaataaatgttagctattactagtctgttccaagttcttataaacttctattgttctagttagtatatcagtgcttcagggataggtatgcttcttcgaactccaatccaagtaatttctacccttatgatagttttctgtttagtaataccactgatcaaattgtgatcaaatcaaagccctgttaccctggatatgttggatgttagattttttccccgtttgactttggggtctgtgtctttcagggcttcttggatttgaagacaatttttcttctatgaatttggacaagaaaataaattcacaaaatcagcctactgggattcatcgggaacccccacctccacccttttcagtgaataaaatgtaagtccc

SEQ ID NO: 138911 - DNA, 2838 bp, Homo sapiens
cctggagtcaactatagccccttatagaacatttatccatatttgactagcttacagcatgaagatacctctttcccatccataagctctcctatcaagtatgagtttggatggagcttaattgaaaggaaatgtggtatagcaattacctttgcattttttaaaaataaagacttggtttccttctgtagttttacttaatgtaaaatttagagaaaataagcccactgcctttgtgttctagatgcaaaagatctttcttacatatgtggcaaaacattttgaggaattatgttagcatattgtgaacatacctttgtatggaagcgaaaagaaagaacttctgttggtttatacttgatctttgttttcaaattatcttttcgtattatgtattagattttttgttggaacttggaatgtgaatggccagtctccagatagcgggttagaaccttggctgaactgtgatcccaatcctcctgatatctactgcattgggtaaagaacacttctggaatttccttttggctatatgtttggtgttcatttacatgatgttttgccttttttaaaaaagactgttggtaaaacctactgtagactatacacgagagttaacttgcgggtcaaatttgtgagaacagaaatgaacagatacctaaaatggtgtaaggaagcatctaattttcttgaaacccgtaggaatctatatattctgcatagaaactaagacttggggtcagttctaacagtgacagttcctaggatataagagcaaagctctgctgttatcctctgtgggaggtattttgatttattttttgcatagcttatgaatgtacttgtgggaattctttagaaaagaaagctacttgttcttactgataacctgggtgaacagagcagttctataaaatttatctctctcccatctttttttcatctaatgtttcaacatatgggacaggaggtagccagagataattatgggatatgtatagatctcatatcccttttttcctcagattccaagaactggacttgagcacagaagccttcttctactttgaatctgtgaaggaacaagaatggtccatggctgtagagagaggtttgcattccaaagccaagtataagaaagtaagccgcatttaattatctttttaagtgtatgactaaatagggctcaccgggagttattccattatctacaacttgttccaaaagaatagtttaattgaattcttctctgtgtgtaatactgggatagggcagattgatcattcatccttatttcctagaaaaaaaaatccctaagctttctgatactatattttcattgcttagatagcttttaggggaaaaaagaattttattatgcttatatcaatacttagtttgaaataattacatataagatttagattactcactgacatggtcagaattgaatgctttacagaaaagcaatatgaaacgtgggcgcatggtgcatgtgttgcaatcagagcaagaatagaagtggtgtggaatttgaacgagttctaaacttggttttaagttaagaggagagttgactttagcaagatgggccaatttgtttgtctttagaaggtatgtggtaaaggcatttagctaccagaagagttaattacagggctatcatactaaggtctctaaaagaagtaatgtgagtaatttttctctacatcttctaacagtttatataggtaataaaactcctggggatgttattcctctcatataggtccctgactaatgtatatctcagacatatttctagctgtagttcacaagttaaaaataagtaaaaaagattgctgtttggttgatttcaatttcttagaaaattagacatcagaaactaggaaggaaaggtggaaggaacaagctgggatagtggctttattatttgaacttttaatgctgcttactcctggtaggctaagaagtgattaaaagaatagatctagagctgaaagtactcattgtccctcccagcttttaactcttattggtcagtgccagattagagcctccccagagaatattagtttccacttgacggggtccactgagaaattagaggatatgaagtcagatttgggcactagtatatcatcttgatggaaaattagtcgtgggacattagaaatgtggcaaagattggtattaacattaaccttttgtaactccccggaactcataggttcaactggtgcgccttgttgggatgatgcttcttatatttgccagaaaggatcagtgtcgatacattcgtgatattgctacagaaacagttggaactggaatcatggggaaaatggtgagttactttggaaatgagcttgattattattcatgttcatgtaaagttcagttgcttgttctgtgtactaattgaataattactcttgctaacagggaaacaaaggtggggtagctgtgagatttgtatttcacaacaccaccttttgcattgtcaattcccatctggctgcacacgtggaggactttgagagaaggaatcaagattataaggacatttgtgcgagaatgagttttgtggtcccaaatcagaccctcccgcagttgaacatcatgaaacatgagtaagtggttaactcacctgtagcctttgagtagtggctacaggagtttggatagtgtagagattaaatgtgagatactgtagagctgtgaagagtgaaagattaccagtgagggattggggtcacaaaggagagggtttttgagtaataacagaatcattgaggcagagaaattagacttgatatcagaggaaaagatagt

SEQ ID NO: 138912 - DNA, 1001 bp, Homo sapiens
cctttaaaattctgtgagtcttttaaagggctagcaatgatttattgagaactcgtattcatgaattataacaataccagtctgtaaactctggaactcctcaccccaactcagttgcaaatcagagtcagggacaaaccaggtctttctcctttatcctcatttctcattgccttcccctgcaaaggcattttagcacaatgccttgtactggaggatggctgctgcttaaagaaaacttttttgagagcctggttcgacaggttagtatacaaaatctctgtctagttttattcatatcatgtattagatattcatgggaggaaaaatataaaatgtgtcagatagattcttcatttgataacaagtcctaaattttacaagaggttctagtctaaaattgtatcagatgttgggcactcaaaatcaacttgacattaaaaggtatcgtaattatagtactataaatatgtaccttataaagactattctaattgctttatttcatgtgatatttaagagtctagataaacccacaaaagcatgtttaattcgtgaagtatctaccaatattaaaacgcctaatccccatggataacagtagtgtgggaggaatgcattcagtattaccactaggaatgccagggagcacatacttttcctcctccctctccactcccagctcctgtgcatctcagacagtaagattgggatttctccttttacctagcagaactaagacatgtaatttagacttgagtgcttagtggtccatagtcagattcgaaacaatccaggttgggagtcactggggaggtatgaggaactttgaggaacccagaccttctgctggcatactgccccatcacccattggttttaggctgcttcaaggtaaatattactatccctattttagagatgaagaaactgaggctctatgaagtttggtaacttgtgtgagggctatacaaaattgccaagaggtggaacgaagatttg

SEQ ID NO: 138913 - DNA, 3034 bp, Homo sapiens
tatcccctgcctctctttttttctcttatgcccaataggaaaataaaaatgggataatgatggatcttctgatccgcaaaggtctgaaatgaaattcatttatagttcagaaggaccttcaaatctgggcactctgggggcctttgaggaggggattgggtacgaggagatagaaaggaatctgggatgctgcttaggagactggctggggtgagaagaatgaaaatggaaagtagagtggtttaccatctccttccagatggccactgttgggcccacagccatattctttcattgaggtatatacctcaatgcacctgcctccaagcagcagacaggaagagacatcaggggcatttggctgggtcagttggcagatgccaaagggcactgaagtctagaactgcacatatttcttgagtgatattctcaaactgcacaaaaatttaaaatgtatagtaaactttgtgtatgaaaaatgtatttcattttcaacaatcataatttatttgaagaattcaaagctgtttaaagcatgtatatctggtaagatagtgagttctaatactgatctgtttctaattctgtaaattaattctaatcatattctgtctgtcaatgactttcttttcctgctccgctctcaggaagaagacagcttcctagaaaaggtaatgcaatccattggtggttatgagagtttccctgtgcttgattaacacttaactgtggtccctggaatttgtccctaggctttcccatatcagagacctctgacttggtgagactcccctaaagtcctgccggctgtccttaagtgtgtttgaagtacaggaaagatatttactgtagcagtcaagtcattgagactcagtacataaaaacagtaggactcaaggttctagatttgtatttttgaaatgagaagtaactacagagccgtcttgatgtatctgaatgctcatgaattggaggggggtaccagttagctgtcctccatttccaatgacaataaaacctgaagaagtagctttctgttgcattaaaaatgatttgaggttaatgatcatagcaattaatttcagaaaaaaatacacagatatgatcaagaaatagagcatagaatagaaccgtggacctgaacaagatcataaaagatcatctggttcaggcctctaccttcagacagggtattttctccattctaatagatgagacaaccaaggcccagaaaggttgaaaaacttgctgaagtcatgcactgtacccacttggtggaatttaatgccttttgatgatggggatggtatactgttttcatgctttagttattaacactaagtaaggttacagagtgtgggcttatcaggcgctgaatgtgtcttgttgaaagaagacaaagtaccttggttttcctttgaaaattagagttcaggataatttgtgaaattattcaagtattttctgtgtatgatctttctctagactttggagacacaactgtggcattccatattatcatacaggaatttgaaaatgaatagtggatggtgtatataatctactgacactttattaacctttttaaaccaccaaggtttgagacagctgtgcttcctagctcttccctgttaagagcagtccatgttctgtctttttatcttaggcagtgccttgtgttgccttaatgccttagtacaggaaaagctccagttggatgtcagactttttaaaaagtacatgaatcagtgctgcataatttctatatggcaagtttggaggcatctgctaaagaatcagtacacgtgctgcatttggtccagagagttagcagagtgcatgatggacagtgttttgtctcaaataccatgtggatgcttggatttgatatttgtaactggaaagaagtaaatggatgagccattgatagacattctggcaactattaggaacatgaatatcaagtgatagaatcccagggaaagaaaggaagcaaactgaatgtggggaaaaaaaagaaagattttaaatggtaaccaactgtcacactcccttctctttcttattcccttggaaaggcacagcagcttttaaaggtcatcagtgcttgttaaagaacacaatgttaagaagagacctcagctcggctgtagtgtatgtggtctctgtcaaagtagtgacatgctcctttttttttcttttaaagctacgtgactgggggttgtggatggaattcacaagttgcacaatgttaggcaagaatttcttagttaaacatacagaatatatatgacctcaagctagaggcgggggagggaggaggatgcaaaaaaattggtcatggttctctccactgggatttttatgaagggtgccttcaggtgcctttactatttcaaacattttttcatgtaatttatatttgattacatgaacctaagataactgagtttatttcctagccatttccaattcacatatagtgattgatttgatttatgtcacttctgggtttttctcttacaaaattctttcagaagaatataacagatagtagaaagatagatgaaaggagtaaaagcccctagaaatcttggctgagctattcctagaaactgtaacttctggactcagaccttaaacttttcgtggtatttctgcctcttggttagctgtattcagtttactatttttggaccttaaggcttacgagttttagcaccttaagattagaacttccatcaagcctgaagtatttacatatgtgggtctaatgttgtggagagttgtctttaattcctgaaaactaaagaagctaatttaaatcaacattgaaaacaaacaacagtatctgtggtaagacctgaaggaagagtaagttagaaataaacaaaaacctaagtgtagaccttgatctctcaaactactgtattgacaattgtaatttaatagtccccaagtcaccagtgctgtatggactccactgtgactgtatcaccggagcactggttctcagtgtcacctttgaaaggat

SEQ ID NO: 138914 - DNA, 1092 bp, Homo sapiens
tttctcatttcctttcaggaacttttgacctctttccatatccagctcttactaaaaggaagcaaggggtagataacaatgacttaaaagcatgggacatagaagccacagcactggtactattctccttcaggtgatcagtcactcctgccaccacacgtactgttgacagggcagggagaaggatgggaaacatgggcacctggtttataggactgctccagtgtcaactgtcactctgcaggctatattcccctgaccctgaagctgggccaaagctgccaagagtctttgaccaattctgtaacaactcacctgcagggcacttgaatcaataaaatatcaaacccccattaggatcaatgtgccctgaataagaggagggaaacagtccctgtaggagcttgaggaaaggagctcgtcggggctctgtgtggcctttctcctggagctcctttcccttgacttaagttgattcagctggcagcaaccactctgtggctgaagcactgctcattttcttggaagccctgccagagccagtcatctgttacgagctgtatcagcgatgtcttgactctgcttatgatccccggatctgccgacaggtgggttctactgacctggggatgtgtttgacgcagattgccccatagagaagtcgtcagttttacagagccagataggcagccagctgtctggtaggatgggtctgcatctgttattaatggcaggacaccaacattgagagttgctacccttaaattttaggttgtgttgtttcctacgatatttgccacctttttcccattggcctatttctgtttacagaaaacatagtggggtggatccctctactctggggtaaattggtgaagctgattgtacgtggaattctggctgacattaccaggaaggatgggtgacacttgggagcctttcttctttttctcttcttggtgtgtgtttttaatcctgaaatgattttaatgcacagtagctgacagtacctgtgaattggactagtgagtattgagaggagtccccatccatgctaagtgacattgtaaagaaaaccattcaaacaaaaaa

SEQ ID NO: 138915 - DNA, 1020 bp, Homo sapiens
cgaagaagactaaggcttttactgttctctgatattctagaagcagacgatctcgggctccaagtatttcagaatgatttaaaaagtcatgccacaggaagggtctattgcagaatttcaagttctgtttatagtaaaaaggaagagcgtttcctaatccctcctttaccatatcctacacagaaaaatacttttagacttatattgccaagccaaagttaccatattttggtgtttttgtgttttctctttataaggcaaaaagatctgtatttacactccttcacctagggatgtgtttgttgccctcctacccaattgtcatgattgtccttagtaccctaggcctagattctgagatcttcccattctaggcctacaagcactacttgctgtagctgagacttgtctagagtcctttgttttgcacttttgacccaccccttcctggatcactcctttgcactccactcccctcgttctgtcactttgaacgaagtctgagtgaggctagtgactccttgggtgtcctcaacagtgaattcactgtctgcgtgcagttattacatgcatttgtgcatttctactacaatggcatctttatgtctctgtaacattggccttttcatggctccacactgggtggaaccatattctcttagatcacatttagtagcataactgtagggactattagagatggcatctcatcgatgagagagaatcacaatcagaatggaagcactttgagtatctgaagagtgagagcattcatgtttgacaggtcctgcttcccactatccttttcctgttattattcaaattttacacaaggactaatcctgggtgtctctgagacccatctcctgcctagacatccacctccagagcaacactggccccacagtaaaagaggaagtcttgtacctcaggcaggcccatctagagctattgctccttcccacagcaaaggtattgtggatgacccttagaatccattctctggtcttctgaaatacc

SEQ ID NO: 138916 - DNA, 1558 bp, Homo sapiens
ctgactctgggctctacaaccagctccttcacataaagggtttagagactccccttggctcccagtcaccatatccagtgttgtgtaaagagactggccaacaggaccaaccaagcaccttacctctcccatacaagatgaccctctgagcttttcatttattcaagctctgtggtacagcctttttttaaaataaattaatctatattggttgacaaacaagccaccaaccactgactgcaaaactgcctgatgcagttgggttcctcctggttttcttttgttacaaccacccttgcctgtttacattaattgcaaggagcataacgtacaggctgtatgtacaatcctgggcattgactctgtgacatttctagcatatccaaggcaccaccagtgatttctcctgtttcttggtgggggtgggggggaaggtacgtattctgcaatatggctaaaccctttcctgattgagagttaaagcaataggagtcaagttactggtgccacagatctggaggtatgataggtcaggggctaggtgttgaacttagttaatggaagactgagagcagaacaggtttgtcatctccgcaaggccagaaagtgatcacaaaaagaggcagatgatagacactggggtagggtcataccacagggaaatacctttcctgggcttgttttctagcatatcactgacctgggatctttgggtgatcaagggtgtggttagtggaggctctgtgctgcacgtatgcagtatcctatctctttctacatcagatcaaaacactaagttggtgtactgcctcgaccttttttcagctcatcctggaacatatacagagttgagagttttagacaatctctaggtagaggagacaagatgtagacccagacagaagaaatctgcttccctaccatggctattccagcaccccaacctgtaattgccaagtcctctaaggtactaatttgtagctgctctgaagtaaggatttcggattcagctggtagggaaagactctgcacctgctgtcttagggaagaaatggttcaaatccatgtggtgacattgcattagtctccctttcactgttttcttattctgtaattgtttgttatatttcccaaaaacgtcttgatcactaagcaaagctgctagtgggattctatatttcgtgtcatcttttttattataatttattgcaaatttttttctgaataaatatatgttgtgtgaaaaagcaaagtgtgattttggtgaggaagcactcagaagggagggcttatgtgtcactgggttccattcgacttgactgcagtccccatcagctgtgcctgcactgtcatcacctgtcttacagggaaataccatttataagaattcttagtatattcaccctcagagatgagaagaaaccatgcgttttcagaggctaataaaggtgtcctgtactttcagaggccagccaagtacccttattttaaccctaaggattcaggcaacaaaacaactcaattagaggaaaggatgttgattcttaatgcatgtaaa

SEQ ID NO: 138917 - DNA, 1067 bp, Homo sapiens
ggggtttcaccatgttgcccaggctggtctcgaactcctgacctcaggtgatctgcccgcctcagcctcccaatgtgctgggattgtaggcatgagccacagtgcctggccctggttgtcatcttatctcttctttataaaaagttattgagacaggcatgggtatcttcaacagatgagaaaacaaaagctcaaggggagtaaactgaagcttgggtgtattaaacattgaacatctctttagcagggacgtctccttactagctccaggagggaccactgggatgaacgctgacccatggcctatctctggtgacattgggctgaggcaggtgaatgcattcaaagcattagagacgccttactgcctgctgcagccccatcccctcactaagtctgccctgtcagggatgactgtagggtaactccagtctccaaggccaggcatgtgttatttattcacaacatgacacagctgctggccacaacagacagaacatcttgtgggttgggttgggggtgggtggggcggtggttcctagttgccatggaaacttgagaaggtgtcaggaacaccacatcatgtaaacattccataattattcatttggactggggcggcagcagacagtcacttcgccaattactaaacgcttggccttgctgggccacgtccaaggctggtgggcctggtgggtgtggttcctcctttggctgtccaggaaccgcccaagcgtgtgggctgctgccagtggctttcctgggacttcactggggctcactgagcactgagctttctccagtcgcacccctccaccagggcatccttcccctgtcttagtctgtttgtgctgctataacaacatacctgagactaagtcacttataactggaaatctctttctcacagttctgcaggccgggaagtccaagatcaagctgctggcaggttcagttgtctgttgagggcagctctctgcatccaagatggcaccttgttgctgcatcctctggaagggaggaacacttgtgtcctcaggtggtggaaaggacagaagagcaaaagg

SEQ ID NO: 138918 - DNA, 1043 bp, Homo sapiens
tccccttggaccccctctcttccctccagatcccagccctcctgcttggggtcactggtctcattctggggctaaaagtttttgagactggctcaaatcctcccaagctgctgcacgtgctgagtccagaggcagtcacagagacctctggccaggggatcctaactgggttcttggggtcttcaggactgaagaggagggagagtggggtcagaagattctcctggccaccaagtgccagcattgcccacaaatccttttaggaatgggacaggtaccttccacttgttgtatttattagtgtagcttctcctttgtctcccatccactctgacacctaagccccactcttttcccattagatatatgtaagtagttgtagtagagataataattgacatttctcgtagactacccagaaacttttttaatacctgtgccattctcaataagaatttatgagatgccagcggcatagcccttcacactctctgtctcatctctcctcctttctcattagccccttttaatttgtttttccttttgactcctgctcccattaggagcaggaatggcagtaataaaagtctgcactttggtcatttcttttcctcagaggaagcctgagtgctcacttaaacactatcccctcagactccctgtgtgaggcctgcagaggccctgaatgcacaaatgggaaaccaaggcacagagaggctctcctctcctctcctctcccccgatgtaccctcaaaaaaaaaaaaatgctaaccagttcttccattaagcctcggctgagtgagggaaagcccagcactgctgccctctcgggtaactcaccctaaggcctcggcccacctctggctatggtaaccacactgggggcttcctccaagccccgctcttccagcacttccaccggcagagtcccagagccacttcaccctgggggtgggctgtggcccccagtcagctctgctcaggacctgctctatttcagggaagaagatttatgtattatatgtggctatatttcctagagc

SEQ ID NO: 138919 - DNA, 1050 bp, Homo sapiens
tcattgtggttttgatttgcatttccctgatgactaatgatgtcgaatatcttttcatgtgcttattggccatttttatgtgctcattggagaagtgtctgttcagagcttttgtctattttttaattggattgtttgtcttttttattgttgagttgtaagagttctttatgtaatctgtatgcaagtctcttaccagatatacaatttgcaaatattttctcctattccatgggttatcttttaattttcttgatagtgtcctttggagcacaaaatttttaaattttgatgtagtccagtttgtctatttttttcttttgttgtttgtactttttggtgtcatatctgagaaactgttgcctaatccaaagtcatgaagatttatgcccttgttttcttgtaagagctgtacagttttggctcttacatttaggtttttgatccattttgagttaatttttatatatggtgtgaggtagagggtccacattctttcttttgcctgtagctatccagttgtctctgcaccatttgttgaaaggactattcttctcccatagacttgtcttggcacccttgttgaaaatctataaatgtgagagttcatttctggactttcagttctattgtattgctcaatatgtctgttcttatgctagtaccacgctgtcttgattactttagcattgtagtaagttttgaaatcaggaaatgtgagtcctccaactttatacttctttttcatgattgttttggctcttctgggtgccttaaatttccgtatgaatcttaggatcaacttgtcatttatgaaaagaagccagctggaattttgatggggatttcattgaatctatagatcaatttggggaaatattgccatcctaacaagattaaatattctgagccatttacatggactgtattttcacatatttaggtatgatttgatttctttcaacaacattttgtagttttcagagtataagttttacacttttgttacatttattcataaatatttgattatttttcatgttattgtaa

SEQ ID NO: 138920 - DNA, 1034 bp, Homo sapiens
tcattttaacattatttttaatgtcagccttggtttttatcttgcagatcaaaggatcatggacagggaagaatcgcgtccagaatccctacagccatggcaatattgtgaagaactgctgtgaagtgctgtgtggccccttgccccccaggtgctcagggcactcaaaagtcctgggactgttgggatgagcagctcaacctgatcctgttaccttgtctgatgtgtttttctgagtgtggcctcttggtgtcaaataggtctttccagggcttgccacttggtaccatgtctacatggaccatagaccatgggctggttgttttggagggatgatctttcattcttaatttcatttgtttgttccctggttaatgtgacatttcctggtttgtggaagaaaaagtgaatgggagataagaggcatgtgctgtgttcaggctagattgccaaaggacaggtttatattttccagtctatgcagcaaaattccgtaggccaggtgggtggaggggtgaatgcccagttctttgttaactctcttatctccttcagtgtgctggatcgaaggggtattttgccactggaggaaagtggaagtcgacctcccagtactcaagagaccagtagcagcctcttgccacagagcccagtaagtgttcctgacttaaggctgggtcgatatagagagggcggaggctaatttacagcttggaaatataattaggcaatattgtattctaatcaccccagcttccctgcctctacacctgccctgatgttgccttcagatctttgtgtccttgatgtagattaagatttagtcatttctttggtgtatattgagtgactctgtgccagccactgtactagctgccagggttataccaatgaatgaggcaaacgatgtccctgctctcaaggagctcattgtctagtgggggcaagaaacaagtaaacaggccattgctcaacattgtgaaaagtgccttgatgaggaaagcataaaatgctataggggcaaagacagaggt

SEQ ID NO: 138921 - DNA, 1279 bp, Homo sapiens
ctcccgagtagcttggactacagatgcccgccaccacgcccagctaattttttgtatttttaatagagacgggggtttcaccatgttggccaggctgttctcgaactcctgaccttgtgatccgcccaccttggcctcccaaagtgccgggattacatgaattttgttttttgacagaatttccattggcagtgatggccaacattgtttagctttggcccctcccatgcatccccttccaagagccaatgatgggtaaataggcacacccttaaataccctagatacgctagaaattctttcataagggatctatccagtaagttcagaattcatctattgttatatatggaaacatggctttttgtgatatacgttccaggaggtaaagatggtctgactggtgctctgaatatgggcggaggcatcaagtctcctgatgttgagttcttcaatactccttaaccacacctcactgttctagaagtcctcatttgcttctttacactctggtccgtcgtgggactgactggatttcatactttcctcgtggctctcaaccagacaaccaatgaagacgtgagtcaactttctcttctcctcaccacatattcttcttcccaaagcctatcctcttgctacctgctagagaactaccgagtctccagggcctgggaggttgaggcaggcagaaacgtggtatgcgaggttgttaagtcagatgtgtggaagagaaaggagagggctttgttgaatgcttgtggagcattaggaagaagaggttgaaaagttgggtgggtatacagcctttaactgttcacaggtccttaaaggctagctggtgcctctgtttggcatggagagggacagttgcactggatgaatccttgctatataaaaagttaccaattaggctgggtgtggtggctcacgcctgtaatcccagcactttgggaggctgaggcgggcggatcacctgaagtcaagagttcaagaccagcctggccaacatggcaaaaccctgtctctactaaaaatacaaaaatatagccggatgtgttagtgtgcacctgtagtcccagctactcgggaggctgaggcaggagaatcacttgaacccgggaggtggaggttgcagcgagcaaagatcacgccactgcactccagcctggacaacagaatgagactctgtctggaaaaaaaaaaaaaaagttagcaattaatctacattcactgtagaaaatcagaaaatacagatgagcaaaaagaaaaaagtaag

SEQ ID NO: 138922 - DNA, 1050 bp, Homo sapiens
tttccccacccttgctaacatggggtatttttattgtttgtaatgttttttaatatgataggtaaaaatggtatctttgtgctttaatttttatttctctgattattagtgaaattggatgttttcatttaatgtatttttagctatttttttaaatgaatgtttttctttgtaatcagaaaaaaaagcctcgaagaaacactttttcttatgtatacaacagaactgcatgcacttagtggagttttatgggcatattctgtgatgttgagtgtctagtctataaaagacagggggcttggggaacctttgaatgcccccattggttttggagaggtggtgagacttttgggctcaagtgatggctagctgtgatattaactgtctttattgatttacagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtgggtgagtaaaactacagggacattgcctagggaaaaggctgagttgaactagaaagtcagggtggtcaccaattttgggaggagggaagatagatttagatgagaaatgaactagatttagatagggaaatttagataggcaacaagctcctgaaaaactgcaaatcagctgtacttgtgtagatcaaatcaaaatttaaatatcctctagcctaaactttacaaaaacctctttagtaaatgagaaaaataaactttacctatttttgaaatttagattttcctgtactggattttcatgtgggacccaccttacatagtgggaggagacacctagtccactggagggcagcattgaggaaggaaggtctgtctaagacgcaacccaagaagaggaaagttgctagcatttattgagtttctactacatattgggcactgtgctaagtgatttacctttctctcatttaagacttgtaacagccccatga

SEQ ID NO: 138923 - DNA, 1108 bp, Homo sapiens
acagatggcctcccctgcacacaaacctgagggcacccctcattgttacattactcagcaatcctcacctattttgttattctgggtcctgtttccttaaggctcagctctcagctagctggtacagtgaaaagccaactgagttgggaacctacagattagttccagcctcagctggaccacatactagttgtgtgcgtggcacatacgtgcttattagaagtgagttgctctttccctcaaaatcactcaacgtaaacagctctatattctgtgtatgtctggtaccagccttggagtgattttttttctgtggtgtaatacctcgtactcgagccactgtttgaagtctgtgtaggtctcgtctctaggggaggtggccggctggattctagggcactgtggcgtgtctcctgggtgtgctgagaatgctctacactctagggatgggagcattgctaattgttttgggattactgtgaggaggcctttgagagccaagaggtgtgtgtgtggactgtaagccacacctgaggtgagcgtgctatggtgtatgtacatgggtgacctggaaatggagggcttatgctggggtgtgtccatgggaggtaggagggggcaccttggccagcctagtggggaagtaaaatgagctctggtcccttggggctcatttttgtccttctgtgagggcttcaggctttcccagtgcacccagagtgatttttgggctgctttgccagacttttgggtggttgcagctggcttgagtaacagcagggggagggagatccagtttataacggggctgggaaagtaaggtcagaggaactctttgttaaaggtccttttgctgctgccgccgctactgctgactttgtgaagtgtttagtgaagtcaggcaggttgctgaaggcttcttatttgctttccagtttgagtttcctgaatgagtgtgtgtgtgtgcatatgtgcacgcacgtgcttgtgtgtggtaccagtgagcatgtgtagtcaggcaggcataagcccctagcattaaaaattgtttttccttctcctcacccttctctccaagtattccttgcctcattcctgtcctgcttct

SEQ ID NO: 138924 - DNA, 1678 bp, Homo sapiens
ttctcgtttccctgctccgctcctaggctgtttttggacctttgccctctccagcccgcgagttggctgtttctccctccgtccgtcgggctgcaggcttccgcctcagtcctgccagcgtggggcatgtggtgtcggtaaatagaggccacaacaccacacctgagcggaggagaagggtagcagaggctgagaaactctgggcctgggaattcaggatgctgagtagagatggtacttaggacatgtcccagaaagcgcccttgtgacttttcttagctgctgccattccccaccccccaaccagccatcagcagtcaccaaccattccagaatctctcctgcttaagtcagcctttcacctacaggtctctgatgtggtttcattaagattctcacaaatgttaggctagaccagccagattgtttcatttcccggactcaggaagttgcagagggtttgatgaggggaaatctgttttgtgtaaatacaatgcacgtatgtgcacagagcgtccagaacctcctggccctgccagagggtgacttgttccctgctgtgattcatattcgagtggctaattgaagaaagaaggtgaagtggaggaagggagggaggttttataaggacagaaactctactattatttttagagtccttttaatgatgttgaaagaacactgtggcatagtggaacatgcccttgactggaagttagcagtatcagcattgctgctgtgtggtcctggataagttatttcctctctctggtcctcagtttactcatttacaaaacaaagtattaataattggcacgatcacctataaaatcctctctagttccaaggttctgtgatgatcagatcatcagcattagattggaagcatagaggcttatttaagaagaaatactagcccctttccttttttgagaaccttttatcataccttcttttagagaacaaacacgaattggaaataaacttttcccacttccccgtccccaccccttcagtcagttttcaactttctgtctctgggaaaggagggttgaactgtattttcttattattgcctcatttttttttctttttctgctttttcttagggctagcaattggacttttgatgatgtttgacccagcggcaggaatagcaggcaacgtgatttcaaagctgggctcagcctctgtttcttctctcgtgtaatcgcaaaacccattttggagcaggaattccaatcatgtctgtgatggtggtgagaaagaaggtgacacggaaatgggagaaactcccaggcaggaacaccttttgctgtgatggccgcgtcatgatggcccggcaaaagggcattttctacctgacccttttcctcatcctggggacatgtacactcttcttcgcctttgagtgagtttcggttgagtagagttacctgattatggttactttgggtccaggggaagaacctgctttctggggagtttggggctggtccttggatgactttaacgtcctcttgagcgatgtctgtagagatgccagctgaattcattgcttcgtggtcatcacagagtatgtacttcctaaaaagaccaatacctttgataccaattttgtagtactgatttggggctgtccttgatagacttgggaaataagaaagtttgtcttaat

SEQ ID NO: 138925 - DNA, 1030 bp, Homo sapiens
tccaatatgttttccactatgcttaccttgtaataaagagaagagatgagggttagacaaccaagtccaagttaggaacagatctccttgctgcatcatgacaaaacatgaccctagaagaaatacaagaaaccaaagccctgtttgaagagagaagtgtttgtctctcccaaccccaagcccccataaaatttattcattcctattatatcgttttgcctaatttcaggcggaaattggctgagaggtctgaggctagtctgaaggtgtcagagttcaatgtcagttctgaaggtaagttgaacaaaggaagatacccatgcatgaaacctgtggagttccaagggcattgtgttcacctcaccccccctaggaactgtttttgatgtggttaatgactcataccataaatacctgggagagtgggtgaagaagtgtagtcagatgcccttcagtttcttccatctctcaaagaaagcctagaaggctgtggtcaaggtatcctacagagtttgatgagatacttataggatagatggacatgaataaagacagctgcctcttagtaacttagtcataattcatatttgtacaatttcatttttatttcagttctcttaacaatgctttgagttaggagacaggcaaatattctcttcagccagagctcagagaggtcacattacttattcaagggcctttgcctagtacagtatttctcaacctttgcttttttattgctcccctgagaggagcctttcaagcctttttttttttttttttttttgagacagagtctcactctatcgcccaggctggagtgcagtggtgcgatcttggctcactgcaaactccgcctcccaggttcacgccattctccttcctcagcctcccgagtatctgggactacaggtgcccgccaccgcgcctggctagttttttgtatttttagtagagacggggtttcaccgtgttagccaggatggtctggatctcctgacctcgtgatccacccgccgcagcctctcaa

SEQ ID NO: 138926 - DNA, 1042 bp, Homo sapiens
aaaaattaaccacgcgtggtggcacgcgcctatagtgccagctacttgggaggattgcctgagcctgggaggcagagatggcaccactgctctccagcctaagtgacagagtgagaccctgtctcaaaacaaacaacaacaacagcaaaaagatcactttggctgtttttatttttggctgttatgtgaagaatgaattgcaatggggcaagagtagaagcaccaggagaaaagcaaatgagttttgaataaatattttcccctatcttctaccccctaacacgtttggggatgaatgtagaagagtgatagtgttggcatggctagaaataggcaattgaagtaagagaattattcttgcttctctgcacatttgccatctactggcattttctactgaggcttctccctacattatattgagatcttgtctcacttcttggtctgaccagaaagtttgacctttccacaggatcaggagaaaagctggtccttgcagatctgcttgagcctgttaaaacttcatcttctttggccactgtgaaaaagcaactgagtagagtcaaatcaaagaagacagtggagttacctctgaacaaagaagagattgaacgggtaagctacagagaaggtggtctattaagggaaagaaattgaattgacaagggaaaatagggtaatagaaagaagggaaagacctgaaaaatgggagaagggggagttgtgatttccccactatggataagattaaaaataatctaggagtgccaggcgcggtggctcacgtctgtaatcccagcactttgggaggctgaggtaggcggatcacctgaggtcaggagttcgagaccagcctgtccaacatggtgaaaccccgtctctactaaaaatacaaaattagccgggtgtggtgtaatcccagctacttgggaggctgaggcaggagaatcccttgaaccaggacgtggaggttgcagtgagctgagattgcaccattgctctccagcctgggcaacacgagtgaaactccatctaaataata

SEQ ID NO: 138927 - DNA, 1029 bp, Homo sapiens
gtaatcttggagatagcaggaaaatgccaagtttgttattaaaaacgagatggggccgggtgtggtggctcacgcctgtaatcccagcactttgggaggccgaggcaggtggatcacctgaggtcaggagtttgagaccatcctggccaacatggcgaaaccccatctctactaaaaatacaaaaattagcggggcatggtggtgtgtgcctgtaatcccagctactaggggggctgaggcaggaggatcacttgaacctgggaggcggaggttgcagtgagccgagattgtgccactgcactccagcctgtgcaatagaatgagactctgtctcaaaatatatatataaataaataaaaaataaaaactagatggtagtggaggaggttacactaagaatagaacaacctcttcaagatagagtgaggctcagatgtcatacattgaatataccatgccgttcattcattctaagactgacttttgagaaattatgctagtagggcacagagaaataaggaagtgcttagttcagagggtgctttgtggctagcaactcctaggtctctccttacaacttagattgcaaagtaccaacaactagtatatgctgtattaggatttctagaaactgaatatcaagtctcagaccaggcacggtggctcacgcctataatccaagcactttgggaggctgaggcaggtggatcacctgaggtcaggagttcaagaccagcctggccaacatggtgaaacctcgtctttactaaaaatatgtaaattagccgggcatggtagcacatgcctgtagtctcagctgctgaggaggctgaggcaggggaatttcttgaatccaggaggcagaaggtacagtgagccgagatcacgccactgcactccagcctgaggaaaaaaaaaaaccctctactctttccccgccctcccccaaaaaaaagaaaagaaaatcgaaagtctgtactatagttttggtccagctccctaaaattttgtttagctgcaaataatta

SEQ ID NO: 138928 - DNA, 5193 bp, Homo sapiens
tctactaaaaaatattaaaaaattagctggacgtggtggcttatgcctgtaatcccagctactcaagaggctgaggcaccagaatcgcttgaacccaggaggcggaggttgcagtaagccaaggttgggccactgtactccaacctgggcaacagagtgagactctgtctcaaaaataaaaaataaaaataaaggctatgggccgggcgtggtggctcacgcctgtaatcccagcactttgggaggctgaggtgggtggatcacaaggtcaggagatcgagaccatcctggctaacacggtgaaaccccgtctctactaaaaatataaaaaattagctgggcacggtggcgggcgcctatagtcccagctacttgggaggctgaggcaggagaatggcatgaacctgggaggcggagcttgcagtgaaccaagatcgtgccactgcactccagcctgggcgacagagcgagactctgtctcaaaaaaaaaaaaaaaaaaaggctatgaaacaatggtgaagacacctgttggatctaatttaacttagggtgtacaaactgattttattaaaatttcaaaaaaattgaattttaagcttttaacaggggaggcaaatcttgttatctgatgagaaatgtgtttggggaagagctggtctgtctccactgctgcctcctctctctcaccttcttcccctactgccctactgaaacttctctcaaaaggcattagtgaggggcctccgaattgccaaatcccaagccctcttagtctttagcatatttgacaccattggcacatttcattctaaaaatctctcccctctagcttctgtgatatactctgggtattttctctctctggctttccttagtcctttttattcttgctctgtaaattccatgacttttttttttttttttttttgagacggagtcttgctctgtcgcccaggctggagtgcagtggtgcaatctcggctcactgcaagctccacctcccgggttcacgccattctcctgcctcagcctcccaagtagctgggactacaggtgcccgccaccacgcccagctaattttttgtattttttagtagagacggggtttcaccgtgttagccaggatggtctcgatctcctgacctcgtgatccgcccacctcggcctcccagaatgctgggattacaggagtgaaaatttcataactttcgactatcactctcaaccccttctttgaagctccagtctcatattccatgtgactagcagggatcacctgggtcccccatatgcaccttaaacttagtccagtccaaagtaagcttcgcatttcctttccccagacttccaaaacctataccacccccttcattctgcaactcagttaacagcataactccctaccccagtcacttaggttggaaacctcagtcatttgattccttcttgaccccttcactgtctccctctccgccagcttatacagggggctagacctgcaaattctgtctctgtaatagcccttatgctcctattttctcttcattttcattttcactgccctaatcgaggccctcattgaacctttcctttggaactttacatatatcctctacacaatcagcaggattttcttgctgaaacacagttgatcattgctctcctgcttaaaatccttcaaaggctgttcacttacagaataaaataaaattacgtagcattttagctatgctggacaacacgttgttctattacataccactcctttccctgtgtctgtgttttttgcttatgctcatctgtttggattttttttcctcctgacagaattgtacttaggcctcaaagcctaattcaaaaggtcacttccttccctaagcctaacctacctcccaataatatttaatggtaatttcctctgtgattacccctatagaataacgtagcagttatgttatttaagggtaacataaagggtatttaacccattatgttatgctgtttgtgttgtatatgtctctgctctcaaaggctgtgagctctatgaggacaggaactatcttaatcaattgtgtattcctagcaccccatacaagtgcctggaatatagctacaatcaataaatgtttgtaaattgaattgaattgaagggacattacaacattgtagtataaatcactttgtagcctgagattgatcactactgcaaatactaaaagtggaagaacatatacctttactattcagtagaatagttttatggttaaatcaatagcatcgtgtaacatgtgatgatgtgcgtttatgcatttatccaaatatttgtaagtttaatactgaccacgatgtatatggctattgaagaaaaccacacataatatgtgtgtgaggtttgaaactagctctgttgcctagggctgtctttgtgccttgccagaatgtggaccgtggcatgatcggcctgaatatttagccatcctcatgatagcatgtggaataactggtttacagttcattcgtttcatacatactctgcctagcatgtaaaattaactggaaactgaggaattggagccaaagttagaaaatgaggagagttcaacttgaaccatcaggaaacaggctgattacatgaaggtctttttgtttgtttgtttttaacataataaatagagatggggtttcaccatgttgcccaggctggtctcaaacttgtgggctcaagcaatcctcctgcctcagcctcccgaagtgctgggattacaggcctgagccaccatgcccatcctatattttttttcaggcaatatccttttgtgctcaagaaattaagacacacaccccaccacaaactacatttgaagactctgccaaaaaaatgccatgttttttctcattttctttcatcagtaattaatgataccaagaacacttatatgcatggtttatagcagttggctatggtcaaaaaaagttgggcttcccctctgagacatttgcagatatatgtcctaggtataccatcagtggcaaataatgcttatcttaagatctaatctcacagggcatgctgggctcacgcctgtaatcccagcactttgggaggccaaggcaggaggatggcttgaggccaggagtttaagaccaacctgggcaacatggcaggaccctgtctctacaaaaaataaaaaaagttagccaggcatggtggcttacacttgtggtcccagctgcgcaggaggctgaggcagaaggatcacttgagcactagaggtggaggttgcagtgagctgagattggagtgccagtggactccagcctgggtgacagagcaagactctgtctcagaaaacaaaaaaaaaaaaaaaaaaaactaaccgccccttccctctagaaatattctaaaagaaggcttatgatatgaatttgagattcctaactataaagtaatagttatgtgcttcaaatgatacataacaatacagggactcaagggcaatgtgcctagattcttaagagaatggaaatcagtttaacatatattggtaatctgggccggcgcggtggctcacgcctgtaatcccagcactttgggaggccgaggcgggcggatcacgaggtcaggagatcgagaccatcccggctaacacggtgaaaccctgtctctactaaaaatacaaaaaattagctgggcgtggtggcaggcatctgtagtcccagctactcgggaggctggggcaggagaatggcgtgaactcaggaggcggagcttgcagtgagccgagatcacgccactgcacttcagcctgggcgacagagcaagactccatctcaaagaaaaaagaaaaaaaaaaacatatattggtaacctgaacacagtgatccccctcagcagtattagagagtagcctcagcgtctccctgctgaagttgtcttatataagaatcaaataaggctttatttatacttctgacaacaagactggaacccccttctcttgctgtaacagccaatcctatccacttatgattccaattatagtgtcataagttagagaatcataggaatgtaaagagagaaagctgtaagagcatggcttaagactcagaatgttttgttgcttctttaaggcaagaactcccctggagcaggaaattttcaacctcctccataagaacaagcagccagtgacagaccctttactgacccctgtggaaaaggcctctctccgagccatgagcctagaagaggtaagtgtgtcataggcccttcagcacacccaggcatgccacgcttctcctagcatttgtcctctggcccaggtgtcactgtaagtctcatttgttgtaggcaaagatgcgacgagcagagcttcagagggctcgggctctgcagtcctactatgaggccaaggctcgaagagagaagaaaatcaaaagtaaaaagtaaggaggcccctgtgaactggccttgggttccacagaagaaagtcatgtggttcatcatgaattctttggagagaacctttgatgcagcaactagagtcatgcagatgaggtcccaaacaggagtgactagccttttgttccccccaaaccaacctcatacagttttgccaaaaagatgactattcagttactttctctgccttccaaggcatcacagagtggttctgcagaatcagctctgaattccagagctgttaaggccaatagggcttccttcctgcctttttgcctctttgaaacttgttcggccgggtgtggtggctatgcttgtaatcccagcactttgggaggccgaggtggatggaccacttgagctcaggagttcaagaccagcctgggcaacatggcaaaactggctgggcacggtggctcacacctgtaatcccagcactttgggaggctcaggcaggtggatcacttgaggtaaggaattcaagaccagcctggccaacatggcgaaaccccatctctactaaaagtacaaaaattagccaggcatggtaatgtgcacctatagtcccagctacttaggaggctgaggcgggaggatcgcttgagcccagcgggtggaggctgcagtgagccaagatcatgtcactgcactccagcctgagtgacagagtgagaccctgtctaaaaaaaaaaatgaaacttgttctacccctcccttgagttatagaggca

SEQ ID NO: 138929 - DNA, 1451 bp, Homo sapiens
caagtcaaaggcaattatggccaaatatgacctggaggtaagagacccttggggtgagagaagatctggaattggaggatgctagcagaagcagagttggggaagagccatgaggatggatggaaaaccaggaatctaaaaaggcatcagaaaaatctctaaggcagaaaggaaaatgaccaggaacaaggtggaaaaggagagatgaaagggaaacagcattgaaggcaagtccaaagggggagaggagctttttaaaatcttatttcaccgttgattccttgaggacaaagaatttgtcttccattttataccatagctattaacccagcattgtatatgcagtttaaacagtaggtaccagtaagaaatactcaccaagtcaaattgagaggaggcagctttatgaaatggaccaggaaaggtgttattgcggtcactaatgacagggctctcatgctgtgactctttcctccaggctcgccaagctatgcaggaacagttgtctaagaacaaagaactgacacagaaactccaggtagcctctgagagtgaggaagaggagggaggcacagaagatgtggaagaactccttgtccctgatgtagtgaatgaagtgcagatgaatgcagatgggccgaatccctggatgctcaggagctgcaccagtgacaccaaagaggctgcaacccaggaggaccctgagcaactgccagagcttgaggcccatggagtttctgaaagtgagggagaagaaagaccagtggcagaagaagaaattttgttgagagaatttgaggaaaggcgatcccttagaaaaagatctgagctcagccaagatgctgagccagcaggcagtcaagaaacaaaaggtgagctgtgatcaaatggaagagggaaattcctagtgctgtggacagactatgggagaaaaaaaaaatgtgtccacccacacacaaaactgcatagtgattaggcgctggggacttgcaagagtgcgtacactggatccctgaagagaaattagattcataactatttttcttcgaagacatttaataagcagtcatctgcatggccgtgcaacgtggttcaggcacattttctgttcttgggggcttacagccttcagaaacccataataactaaaccatactcgaagtcagggtatgagttagcgttcctggtacctacacaccagggagaagtacgtatggtagaatggcaaatctgaaagtccattcacacctgtagacacagataggtcaattttgagacattaggaaacattgtctagttgctggatttttttgttttgttggttaagtaggagtggcatttttagcacttcttaatgctagttgatgtgtgtatacatggggtgagactttacggaatgaatgactccacagggccacatggcaaattagaattgtgactccatactcagg

SEQ ID NO: 138930 - DNA, 1051 bp, Homo sapiens
gatggcaaaaatctggttttacacggcaaaagaattatttttttctacttttttttgtttaagagacagggttttgctctgtcatccaggctggaatacagcagtgcaatcataccttactgcagcctaagacctcccaggctcaagcgatcctcttggctcagcctcccaactagctgggactacatgcacgtgccaccatgctgagctaagtttttgtagagactgaggtcttgctctgttgcccaggctggtcttgaattcctggcctcaagctatcctctcacctcagcctcccaaagtgttaggattacaagtgtgagccaccgcacccagcctccttttttttttcctttttttttttcaggtttccacatacaaaaatttattttaaaagagctatcatttagaatatattatagggacctttacttaatagttttggctggatatttttgggattaataattgcaagtagtcacttctgagagaattttggaaagcagcacagcgggctgagattgtgggggtgtacatatatgaccacaggaccctagtggctttctcttgagccccctcaacaactggccatctagctaaatgtgcagagcggctgactgtgatatgaaagaatgaaagatagatttgcatttccttggacagtaaataaattgaattttctcacaccttccaagagtgtcctaaaatactggaaagccacggaccccagtgaaaatgagcaaggaaacctgattcttgagaaataaacgtacatgtgtccaaaggccagatctaaggagctacaatggcttcatgccaaagctagacagcaggatcaacttgggaatggaggcaacttgagtcaatgaaaaagacagtttagaagcatgtcactgccaggtttccctccagactgttttgagacaggtctctgtcatacaggctggagtgcagtggtgcaacctcggctcactgcaagctccacctcccaggttcaagcaatcctcctgcctcagcctgcaagtagctgggattacaggcatatgccacc

SEQ ID NO: 138931 - DNA, 1030 bp, Homo sapiens
ttcagtgggatctcagatggtctaagactccccagttaatctgaaacttaaagtgaagcgtcctggcacctgtcttttcagggatataagctggaggaagcctacagtctggccacttagagctcctgctgctaacacgggccattccttcctccaccctgcagcttccttactgaaaagtttaaaattgtgtcatatgataatgagctagggatatttaccctagagggaagaaaatttgagcatgattggctgtgcactggtttgtatcgcaagaccatcattgttcagcacttccccctagggggcgctaaaatgtcacgacccgaaattcaagcgttctcgccatgaaccacagctcataagccaagctgtagctctcgcttgtttcttcccaggaagatgaagaggagagaaaccataggcagatgataaaggaagcttttgctggggatgatgtcatcagagatttcttgaaagagaagagggaagctgtggaggcgagtaagccaaaggacgtggacctgacactacctggctggggcgagtggggtggtgtgggcctaaagcccagtgccaagaaaagacgccggtaagaatgccgaagaaagtctgtcaaaagggcaccgggttctcccctcgcccttcggtgtcctccctacccttttgactaagtccttaatgctcctagtcagatgtcctgttgttttgctttccaggtttctcattaaagcccctgagggtcctccaagaaaagataagaatttgccaaatgtgattatcaatgagaagcgcaacatccacgcagctgctcatcaggtgagagcttagagagctctttagctgcctgcttgttactgcctggctctcttgcttgagaggagtattctagtgatctgtagtcaagagagacgtgtgatcttgaccgcagaatcaaatctgttgttttcactgaatggctgttagatttatcatttcagatagactacgctgttttaattactggccaggaaaaaagtttagagtcaag

SEQ ID NO: 138932 - DNA, 1065 bp, Homo sapiens
aagtttgggtgggaaagtgaacaccggagtggaacagagagggtgctggagaaagtgacacaattgttggggtagaataggaaaaggtagaagccactgatgattacataacccagagggaagaccctaggcctttgagttttcaaagagaagggaagtttcttaatgctggagtttgaattaggtgtgagtccatggttgccagagtgtttagtgtcaggatggccaaagagggaggtaatatctacttttcggccactaggatgctagtacagtatttgatataattttacatatgaactaggctttattaatgcccatttttgaatggttatccttaaaataatgtagaaatggttctttttctaaattaaatcattccctttcccactgttcataacttaaaagcaatcttttatgatgagaactttctttggcgaactgaagtttcattctggtcaagagtaaaatttaactctgtgtttctatccccgtaattcaaatatgctgttctagttttcttttttattctaagcagaagtgaccttttccccataaaacataaaaaaggatcttttttttaaaaaaaaaaagtaactgagtaactgcaggctgcatgtcaaggtcatattttccctggtcaatgaattatgatgaatttgaatacagctgatatattatttgtaaaatgtggtaattttcagatttactcatcacagtatgtgaggcaggatacctcttcatttgtattttaagaaaaccttaagctgaaggtccgtgaggaatccagagtaccaaggagcagggaaagctttgtgttttgggcttctttaccgtgggtctgctgagaaacaaaatttggttacctcattactaaggtatgcctagaaatcatagtgttagtgccatttaagggtactgttgagttttgttataatgctgatgtccagggacaaggagaacaagcagatttttgcttttccaagttttgtggagaagtgcaccgtatatgactatgatcgcagaggtgagttgatgcactgtatacctgaatccatgagatga

SEQ ID NO: 138933 - DNA, 1052 bp, Homo sapiens
ttgcccaggctggagtgcagtggcgctatctcggctcactgcaagctctgcctcctggattcacgccatcctcctgcctcagcctcctgagtagctgggactacaggcgcccaccaccgtgcccggctaattttttgtatttttagtagagacggggtttcactgtgttagccaggatggtctcaatctcctcacctcgtgatccgcccgccttggcctcccaaagtgctgggattacaggcatgagccactgtgcccggccctattattatattattatctaatttttcttgttcaattgtatcctattatgttatagtaaacatggtggcagcatgaaaactatcaacagcttctcagtggtccccttatatcttgattctctgtcctctttcttcatattcctgttgtattagtacacatttggcatttacaacatgctaggaagaaagcttgactcatcactgcatctacctttgaggtggaagtggcggcttctttaacagctatgctgtaacactgctcaatagttcaggacaggaactgaggagtgtatatccagttgaaactctagggaacatttcgggccatgggtgacatttttaaaaaccattgctttctgaaaagggctgttgtgtttatttaattaattaatttatttgtttatttattgattgatttatttgaaaccgagcctcactctgttgcccaggttagagtgcagtggcgtgatctcggcttactgcaacctccgcctcctgggttcaagcgattcttctgcctcagcctcccgtgtagctgggactataggtgtgagccaccatgcctggctaatttttgtatttatattatttatttattttttgagatagagtttcgttcttgttgcccaggctggagtgcagtgatgcaatcttggctcactgcaacctccttctccttgtttcaagtgattctcctgcctcagccttctgagtagctgggattataggcacccaccaccacgcctggctgatttttgtattttttctagtagagatggggttttgcca

SEQ ID NO: 138934 - DNA, 1063 bp, Homo sapiens
tgcccccccaccatgcccagctaattttttgtgtttttagtggagacagggtttcaccatgttggccaggctggtcttgaactcctgacctcaggtgatcgcctgccttggcttcccaaagtgctgggattacaggcgtgagccaccatgtccggccagtctatggtccttttctaagtgctttcatgttattccaaatttttagtagggactagtagtttattcccattttgcaggtgacatggtaaatggacatagagagatagtctgagatggctgagaagtggggactgggagtgttctccaagttttcccaccgcagtgtaggctatgggtgctagagtatatcacttttcaaggcattacttgattagatggttctgtttaatattgctgctgtttgagtagattgttctgaatggattttggatgttcctaaacatcagatcgaccctgaaaggatgggttccagcactaatgaggagagtgaaaaggacgtagtattggtctggatgctaacgctcacagaggaactccagggagattgcaagccctggccgctcggctgagatgactgtccagcctcctgaggcgactactttggggtaactacattcatttgaatgataaacgctcatgtgtttaacagcagttaacattcctttgtatccagtctcataaatgtttataggtaaggttttagacatggaagtacccaaagagtctatgaaggggtccatgctagacctatatgccggcaactacctagccttcccactaaataccagaattaatgtatctgggcaaaagatacaatatgccttataagactgatcccttggggtagatatcagtggaaatatttggataggaaaaaaaaaatccaggggaagtagaaagtgttagaatagatttttagtcaggcagaagtttgggatgaacagcagaaagggctgttctttctcctttaaattgcctggcagattatttctagttgattttgtgtgtgcagtagtagaggaaccaacttggcatgaagagaagcaaagtaaagtgtttgggg

SEQ ID NO: 138935 - DNA, 1050 bp, Homo sapiens
tttttcccagccacacttatggctttggattggcagagcacgtgctctcctttgtcctcaccatgagttggatatatcttttgagttttttcccccaaagtagggatagctcacagtggttcctctgccttccaggcagtgaccagggttgattcttgggccatgcagctgttcatttctttaacaattacatggttgtgacatctgggaaaatcctttgaggtatttcatatccttgtgcctgtgcttcctgggtcatttgggattaccaggtttcttccaagttcctttttggaactttgcttttgatgtgatgatttccatcagagagagggagagtaggcggggtggtggggggaggtgggaagggagaacacatgagtaccggtgcttcaagcaaaagcaagccagcatacaagtgtgtaaaccagcagcgcttacgaagtgtggcatgcctgcaaggcttttcctttttgctcacctctcctgggatactaatttgattggctataatataataaaacaaacccctaggcctactgaatcagaatctccaggactgagacctaggaatctgtattttgaacaagctcctcggtgattctggctggggaaacattggttgacattgaccgtcctgactcctcccttctgtgagcattcacgcagtcaggagtctgttctctagggccgctttagaggttccctttgctttccctctggctggggaagaccaatcttgccttcttgtatagaccatgtagctcagtgtcagtgttctcctgcctgtgttttatccctcccctcctctcctctcatctgcagaggctactgttaattagcaacagtgggcttcagataggaagtggcgctcctgggacaaaatcatgatagaaaattgagaggcaaagatttaagtggatgctccatcttgaggatcttgtgaaaatggagttatccagaatcagcgttgctctctacgtggtcataacatgtgtattatatagtaattattttgatattttaactcggttttattttttgtggttt

SEQ ID NO: 138936 - DNA, 1046 bp, Homo sapiens
ggctaattttttgtagagatggggtttcgccatgttgcccaggctggtcttgaactcctggactcaagcaatcctcccagctcaacctcccaaagttctgggattacaggtgtgagccactgtgcccaaccagtgttgttggttaaaatggggatattccaagatattctgagaaacagtcaaaacttgattaaccaggatgttcagggaacggggtccttgttaaaaatatttctaaaattatgctaacccacataactgtcttcataatgttaaaagataattgtcagaaaaaaggtaaaaaatcatgactctcgtacagatacaaaaatgaacacgtgttaaagattttattttactcattaatcaacaagagaaccagacagatgttatagctggttcaaacaaaaagtcaaaaagcacaaatttatatggagtaaaggaaataaattgcaaatggaggcaaaagtagtttttctacagtggggaggaaagacaatccaaactcaatgggacaagacagacttcgcatatacatcagttacctgcaattacagagatgcaaaatagcttgaagacaataacctgagctaaaatcagatagcccagaaggttatgctatagacagtgcatagttttttcattggagtacaaaggtttttctgtagtaagcaaacatggtggatgctttgtgtgtgtgtgtgtgtgtgtgtgtgtgtgtgtcggggggtggctgttgattttgcttcttgtgatttctcagggccgtcacttcagttcttatccagaattcagttccatataacatgcatttactgagtagttactatacgtaaggtgtcgtggaggaaacaaagacaaaaaaggatgctttttttttctttttcttttttttgtttttgagatggagttccacccttgttgcccaggctggagtgcaatggtgcgatcttggctcacctcaacctccgcctcccaggttcaagcaattctcctgcctcagcctcccaagtagctgggattataggcatgtgccaccatgcccg

SEQ ID NO: 138937 - DNA, 1018 bp, Homo sapiens
tttactatgttggccaggctggtctcgaactcctgacctcatgatccactcacctcggcctcccaaagtgctgggattacaggtgtgagccactgcactcggccgcctctctcatttttagagaaggcactgctccttcatgcttgctggtgtttttttgttgtttcaatccattgactgtttaaattcaaatatacatcagataaatcaccaagacacagaacaatatggctttccctgggattcaagatctgacgtttcttgggtaaatcttagaaatgtgtgtgcgcatataggggagtattggtaatttgaagggaaaaggaatggaagtctttgtgtttatctactttgttcttctgttcctaactggagaagtatatacttgtctgaggtcaaggttagcagaatagacctttttattttcttaagccattagtgcctgatagcttaatgttctctgtactgaggaacaagttagagatgggcttaaaaggaatttaattttaggataaaaagagtcaagaccatggaaaatgagatgaaattcttaggtgctcaggaagaaaagtgttttcctttacatatgaagcatgtcctcagatgatcactaagagatgatctagggaaaggcagggtgatgataatgatttgcgtaagtattcattggcaggtcatgttgacctagttataagtagttgagactttgatgcagaaatctggactagagccttcaaaagaccagcggggccgggtgctgtggcttatgcctgtaatcccagcactttgggaggccgaggcgggtggatcacctgaggtcaggagttcaagaccagcctggccaacatggcgaaaccccgtctctactaaaaatacaaaaaaattagccaggcatggtggtgtatgcctgtaatcccagctactggggagactgaggcaagacaatcagttgaacccgagaggtggaggttgcagtgagccgagattgcaccactgcactccaaccggggtgacagag

SEQ ID NO: 138938 - DNA, 1041 bp, Homo sapiens
accacgataaccttctagcaggcgaggcatgggtcagcttaggggaaaaacagctcaagcaagtttaacccttcctttcctcctcggacctgcttttattgttccaacgttttgcttattctgcactccctgcatactagaatactggaaatccctacattgccctatttcttgtttagtggcacagagagacctcaaagctcgtgagaatacgtgactgttaggctgagagtgtccttgcagtgtgtgagcacagccattgtgcctcttagatgtgccaggcagtgggcgtgggagaagctgagctgaagcagccgaggaagtgattcagggaagataggtagcgagagctgatgcccagaggcccgggctgggggccagacccccgggtcctagtcccaattctgggtctttctcactgcaagcacaaatgtgctaacttgcgggttggcctggtaagtggcagtccctgagccagtggacacatgggattgtgtgttaccctggacaagtcattcaaccctttgtcttggagcctccgttttcttatctgttcagtggggataatattagcttctcctcccagggttgtggggaggataaaatccaataatagagatgagagcatttggaaaggctgaaagtgctacagagtataaagtggcattatgaataatgcttgggccttttcactgggttttataaatatgaggatatttgaattgctcctgtgtcatgtttttcttcttgccttagttgaatctattttctggtattaatttacacgtgaaaagagacaatttttcttgagttggcctgtactgagaattattttcagttgttggtgcaataccattcacagtgaagttatttgaacaatgtagtctcccaacttgcagaagaggcattttgtttaatgccggtctctccattggtgtttgggtacagagagtatggggcctgactttgcaccttttaaaatgactttgggtgtttattcactggcttttgaacgcagactctgtagacctctttaaagtg

SEQ ID NO: 138939 - DNA, 1025 bp, Homo sapiens
gtgagtgagactaaggtgatggcccctctcagcatcttctatgaaaagagagatcgaaatctggttgagcagttttaccatgggcccaggtgtcgagttgggaatttgattcactgtgccacaatgcccagctccttgcagagataagagagccctgggtgggggcaggggacaaatagtcctcaaatattgcccactgtttgaggattatttgttcaacttttcagagcagggatttgacatctcttgttgggagctgatggtggaaagaggtaaggcctgtgccactcgggaaagctggttcaactccaagctttggcacctcgtcattactggggctaatctcaggcacagacatttaactttctaccttggtcttattgccctatgtgacaggcagcctcaaagttggaaaagtcattgaatcgtcagggctggcagaatcacatttggctccctgaatttgtgttggtcaacctctagggactaaaaaaagctagccctttctagccaccactaccttctgctagcctccacactggtatccagggctggagatagttgtcccagttcacccaatttccatgcaaattggatagaatggggaagcaaggtatagtgtaaactcagttatctgacattctagtaaccggcaccttagcacatggcaagcgaggtggtaattggggctcataatgatggcctggaggccttacaaaatcctgaagtgtcctctgaattatcaaagagcaattacattacagccagtcccattttagtgttaaacacattgtactgtatttgattctttggaaattggtgatccctttgtgatctctatgatgattctgtattaaccagaatattagattaaccagaacactttgttttgcctagtctatataatggaaaatgtgctgttatttgctgtcttttagcagtgtgactaacttgaagctttggtcaagggctacttactctatttgcctcgaaccatttctttcttctgctgacttcgcttgggt

SEQ ID NO: 138940 - DNA, 1057 bp, Homo sapiens
aattgattgcctcctatgatgtattcatcctgagctgccggtaaacatccgctgtctccttattagctaaaactgaataacctcatattgagtgggtagtagagtccaggtttgctataatgcaaagacggcttaacctcatttccggctctgtttaagtggaggtgtatatgatacccatctctacgctcaagagagtaattgagctaattttcatcaactatgtgacagagtgggaacaattctctttcttctgctagagcaataatagattggtcaggaatgagttgtcaagctgttggcctcagccacttgtgttaggatgaagaggagcttttgtgtatcacctaatcttctctaatggcacctggtttcctagcatggaagcttcctgtggaacatattggcgcttggaaccagaaggaccttcgaggttgcctggtccagtttgccacccaatgcaaagatagagatctccacagcattcttgacaggtagccagccagccttttcatgaacacacctccagtaacgcagagaacaccaccaatcaaggcatcctacttgatttgggggcagctccagttgttggaaagtaggtcattcttcctctgtggatgtgtctaagggttttgcattgaggcagctggatttggcacatggtctggttactttcctccagatctgatgatggcatcttcgtgcaggaatttggcaaaggccaaatgaggcaggttaccctgcttctgtctgagcctcctgacttttcttttcatcctggttttggttatctcccttcttgacctgcggagcaggtaggcagagccacttccactcacacacctgccacctccgctctctagtcctttgtgggctactataaagccttcacttctctgcaattgaataaacacccgagcctgccctgccctgggtaaacaaggtggggggctgtttctttgcctgtagcattgaacactgtaatatgacttcttcatgtttcctggggtcctcacaaggcatggttctgttccttcctcttttgcctcagcccaaa

SEQ ID NO: 138941 - DNA, 1129 bp, Homo sapiens
atttattgagcacttcttttgtcatgtgaagagcctgattactttgtatcatttaatctcacagtaagccgatggagtagatttattatccccattttataggtgagaaaatcgaggctttgcagtgttactgatatgtctaagatcactcaactactacgcatatgagtctgaattcaaaccaaggtcttttgattcccaagtgccagggtaggtggaagactgactcattcaccataattcagttacaccttggacgtttccattgttccccactttttattgagtgtgtatctttgcctaccatatggattatttcctcagggtatgctcctagcagtggagttgctgggttagttacagagtgtgcctttggttttaaggctttccatccctatacctgagttgtttcacaccagccacactcccagccagactggtcagctctggggagctgacgtgacagtgtctcactggcaagcagcccatctttcatgagcacctagtgtgcgtgcctggatagctgccgagggagacctaaaacaaaaatcaagaccaatccctgccgtcaaggttaatttaattgtcttgtaccctgggcaaaaccagccaacaggaaaccattggaggggccaatgggacagggctggagcactaaggcagcctgtcagggagggtggaaggagcccttttgggcctgggggaagaggcagacatctgcactggtgaggagggtgggaagcctcgggctttctcccgggtaaaggagcttgacagtttctatatacagccagcagcacccctgacacaggctgcacacacagccgctctagccagctagcctgtgagctgtcagacagaaaggtggagtggcccatctccccagtgccccagagaggactggcaatggtgcagctatgggatccattgtttggaaagccaggcagccattaatgctgccagcctctcccctcctcacctcattcacccagcttcagcccatgctagctagggtgcttcaagtccctggtgtcccacctgtagtcctagcatcatctcaatccaaggaaggcagtcattaaagtgtggatgaatggcagtattggattatcctttttttttttttttg

SEQ ID NO: 138942 - DNA, 1216 bp, Homo sapiens
cctgcaactggttcctcttttccgatgtcttgaagaggctgaagctttcctcgaggatctttcaggcccggttcccgcactttgaaatcaccaccatgcccaaggccgagttctacaggcaggtggcctccagtcagctgctgacccctgccgagaggcctggaggcttggacgacagatcccccccaggctcctctgagactgtggagctggtgcggtacgagccagacctacttcggctcctagggtccgaggtggaattccagtcttgcaacagttgaccgggaaaacagcccctcctcttctttctccttccgagttcgcccttcccccacctccttgtctttccccgaccgagcaccagactgcagaatgaggcaataatacggaccaacaagaagccgccttatcaatgccagcattagcgactggactgtttttgtttttttggttacaattagttctcatctccctgtcgtcgtcattgttatcgtggttgctgatgggggtggaaagttgaactccatgtctgaggacaagaggtcccgggggtggtgggaggtggcgccggggtcccttggactggcctccttgttcatgaccaagaccaaacctgggccctggatggccttggcctgtcccgaggagaaatgagaaaatcccagatctctgagcgccccccaactccattcccctgtgttcttctgtcttctgtagtatttattttattagtatttaatttgtattgtttcattggtttctgataagtctgtatcactgtgacgatttgagacaacttgttgtattgagggactttctgtacctccttttctttttctttgttgatgagctctgacaaagctattccctggtgtttttttcccccactggggagggggtgaggtggaatggggtgggggaacatggacttgtgactaacgaagctggttgctgctggcccagggctgggggcttgggggtaaatcctgaggctttggtgctcccccacccacccattcccgccctttgcagcagccccgctatcttgagattagtgttgacagggaggggaggattgtgaggtgaggggttaataagttactctaataaaggagcgtggagaagggatctgaggggtgagggtggcccccctcctcacgccttcttcactgcccccctcagagtgcacaatacgagtttgttcctgcctccactc

SEQ ID NO: 138943 - DNA, 1154 bp, Homo sapiens
aaaaaaaagaaacgaaaaggaaagaaagaaaatccatccacagccaggcacagtggctcacgcctgtgatcccagcactttgggaagctgaggtgggcggatcacctgaggtcaggagttggagaccaacatggccaatatggcgaaaccccatctctactaaaaatacaaaaattaaccgggcttggtggcacgcacctataatcccagctactggggaggctgaggcagagaatcccttgaacctggaggtggaatttgcagtgagtcgagattgtacctgggtgatcaaagcaagactgtctcaaaaaaaaaaaaaaaaaaaaagaaaagaaaaaaagtacaatccatccttcaagatctgattggttccactcaatcagaatgtccttcctatcctgctagtaccaattaaattgtgtccctccttcaagactcgattcatggactctgcctccccagaccagtctgtcctaagtgagttatttaaaacttattgcaattgccactctttcagcaactgatcatgaacaccctgtgacatctattataatgcaaactgttacttaaatcttcaatgacctgtacctatttagtgtccccaattagcacattacctccttgaggagtgggagggactgtatcaaccacgtaacatggcacagtacaaaggatcaaggtaatggttactgatggagccggtgggagatggggaccaaactttgaggtaggtgacctctgacctcccctctgcacaggcactcaccccaggtgctccactgctctgggcctgccctccctggctcagtgccctcatggtatccccaaccccacccccccatcttagcactcaaaatttgttactattttgaacatcctctacccctaaagcaacttccctgtccagtttctttcctactccaagtgtgaaactagctaaaccaattaacctgtgctgatacagttatgggagagggctagaggagaacctcaggagacaggttcattttaaccagagtcatgtggcagtaagtctctgccttttcttggtttaatggagtcaggagtcaagagatgaccctcatctcccagcagctgatatgttactccctcctctgggttcccacagcactttgttttctttatttttttga

SEQ ID NO: 138944 - DNA, 1058 bp, Homo sapiens
tgtgaccacatctgggagccttctgacaagatcccccaccccagcccctttctccccattcaaccctacttccctcattaagatggagccccatgacatataagcaaaggggtcagggcaagtgtgacccaccaggcaaaattgagcagcattttcatagggaccgacttcagtagcacacctgcccctgcatttcagtgggatgtcaatacacttgaccccaagtcccccggccctgcctggtgtcactgtggccaaacagtgcccagcttaagcatccctggcatcagactatggccttcaagagcactagggcatatgcttttggcagcataacgggctgacttggtgatggagggaaaaagccttgagccaggcagaagtttgtggccagggtttgtgcagcagctttgtgagaagagcccttctacctggctctatctcactggctgcattccctacacagggaatttactaccctatatgtgaatatccctgtatgtacttgtgtgtacttgttggtctgtatcttagtttctttggggaggacagggctgtagctgtgaggtcttgtctccaagggtgtgtgtatgtctccgtggatcagccacagggatagggattttgtttttaagggaaagcattctctaattccctttgttcatgccgagattcagttgctctgagactatggggtacaagtttgatcctccgaatctggagatgttgtagagctggaacgagtgcagagtaggaacgctttgatgcgcatgcacattggggaagatgcgctcctcagggacacaaaggccgagtggggtaaaaccacgaagggagggaagggaagtcagctctgggagcagccctcactggctggaccaaggtactcttcctggagtttgccgtgttagcaaccacagtcaccttgcagtcaggctggaatcttgggccaccccaaagtgctttgctgaaggatttagacggggatgaagtgccctccagcctcagagctagccacaaagcccccagagctgaattcattgagtatttgtgcctag

SEQ ID NO: 138945 - DNA, 1052 bp, Homo sapiens
aaactactgaaaattgtattctagagacctagaaggacagttaaaatttcttggaagtatgacttttgatcttaaatgtgaatgttgcaatctactgcctcgagtacattttaagtgatttatcagtgaacaaaatggaggcccctggaagatgagcccagtctggactgtggctttgacgcctagtctggggcttggtcagctttggcatgcaggccctgtctctgtagggcctgcctgcaggtgggtcagaggttgaactttcagaaatgtagcctaaagtgctggaagggaaatctgtcaccctcagcatcttcatttgcttccagtctccgtccctgtctccctttgtgattcaaacacatttgatggaaaaatctaggcccttctgtcctgggggataatcttttagctcgctcagtggttaggtctggcctcatcctagcctttgggtgggtgcatagatcccagggtgggatggacacagacagcttgggacccatgaggctcagaagcctgggtatggattggccaagattgtgcccaaggacttcccagcctcatctcctccatcacagtcagcctgcagcccctcattcagccccacctttagcttagagtgtttacagtgctctccagtaaaaaacaaatatatctgcccggacttgcagtgcctttcagcctagagctacccaccgtcatctctgggtggctaagtacagaagagccgaggaggcactccaggtcaaagttagcttccttagcagcaccacgtctcattcctgtctccatagcctgcagatagagaaggtacaatttaaaaagaacgcatgccctctccagcttgagcaagctgcataaagcactatgaatattcaggtttcgctctggcaggcagggccccaggcactgcgggcctgtgccaggcagcaatccttcgtccacaccccctgcctgcccatggctcaggggggctccaggctgcgggagcctgtagtgacgaaagagcaggtagggccctgggcaggctgtctgggccaggcagggcgggg

SEQ ID NO: 138946 - DNA, 1010 bp, Homo sapiens
ctcagtcccttggtccccacccctcagttagaactgctaggctttgggggatgggagggtggcaattattcttaacctcccgaaattcctgatgacccgataacaaggaggtatttagacatagaatgaggagctaatctttttcctataatgccccctgaggataacagaggctagttcagctctgctaattctatgagaatctatgcacagaaaacacctgtctcattagatgaccacttctaattagccattctaataagtgtgcagtggtatctcattgtgattttaatttgtattttcctgatgatgtttgtattgactgatgatgttgaacatcttttcatatagttgctgtccatatgtcttctttgttgaggtgtctgttcaaatcttttgcccatttttaaactgaattgtttgttttcttgtagttgagttgtgagagttctttatattttttggatacaagactttcatcagatacatgctttgtaaatactttctcgtagtctgtggcttcttttaatccccttctcagtgtcttttgactttagcaaacattttaaattttgatgaaagtgcaacttttcaacttttctttttatgggtcatagttttggtgctgtatcgaagaactcttcccctagccttagttcacaaatattttgtctcatattttcttttataggttttataatattagtctttacattttagtctatggtctgctttgagttaatttttctgtatgttgagtggtatggatccaaattcttttccttccttccttccttccttccttcctccctcccttccttccttcctccctccctccttctctctctttctttctttctttctttctttctttctttctttctctctctctctctctctctctctctctctctcatctttatcttgctttcttgctttcttctttctttctttttcttggtcttgctctgttgcccaggctggagtgcagtggtatgattatggttcat

SEQ ID NO: 138947 - DNA, 1043 bp, Homo sapiens
tgctctgtcgcccaggctggagtgcagtggtgtgatcttggctcactgcaacctccatctcccgggttcaagcaattctcctgcctcagcctcctaagtagctgggattacaagcacctaccaccatgcccagctaattttcttttttttttgtattttttagtaaagacggggtttcaccatgttggccagcctggtctcgaacccctgacctcaggtgatccacctgtcttggcctcccaaagtgctgggattacaggcatgagccaccgcacccagccgagttgccaccttcttgatgggtcattttcttggcccagtgtgggcacttcctgcctctcagaacacctgactctcctgaagcttcctttcctcttccagtgtgacccaatatccttcccaatacatgttattgtctagaggaggaagagcacaggctctctacatttatatgccaaacttactggctgtgtgactatttgctgttgagctagttacttaaccactctgggagtcagcgcccatctcacagggttggagtgaagcttaaatgagacgatgcatataaagcactcagcagagtgcctggcatatagtacccacccagtaagtgttcactgctgttattattattcctgtgacagttattattattgttgtcaccatttccccttcacacacccttgactttgccaggctctagggaccaactacttcttcggcaatgcgggcagggcatgccacacccatttctgaaactaagcgggagattttccaggtttttctgctttttgttaactcggccattgcacaggatagggaaaggatgtaatagaaggtgtgtgtgtgtgtgtgtgtgtgtgtgtgtgtgtgtgtgtgtaatatactgaatggcaggcagtgctgtagtgaagagcaaaactcaaatcgttaatatttgtactaacattgccttctttagtccttcaccattttcatcttgagcatcattcactgcagaaataagagtaagttagtttctttgagaggcctaacgttgtact

SEQ ID NO: 138948 - DNA, 1050 bp, Homo sapiens
tggtttctgcatgagctacaggtggcaatcttgcaggatgtcatttgttgggttccagggcaggatggcatttcttagggacaccccccaaacatccctatagccccctgcagtggaaggggtcatgtctgccatgccccctgtctccccaggatctcccaccgagctgggaaaggccctgggcagccttctgtcctcagggtagggcctgaccccaacccgggcttggcatctctcctggatttctaagctgcaaagaggtttctggcttctcttccaatttattctttttgtggttctcagactgaaaactacttctgcaggggagaaaggaaactcctgcaaggcacccagaatcccataggcgctttcctaggggtcaggggcttttctcatcaacaccaacctgcctgcaaatctctggccgctgagcctcgtgtgtcctgtaatagcagccacactgctaatgccctgtagctcgggccccagtgctggttgccaagaaactgctggtcggggtgcttatgagggttctgacctcataggggctgctgagtttcaattcaacagacatttattaatacctactgtgtgcccaaccgatgctaggcgccgtgggggagatgagagaaggaggcgctggggaagagatgactaagacactgaaacaatcagaggcgaggacaagcagccgggccagtggctggtcaggtgctaattgtgcttgttggagcagaggccagcacggctgggactggaggtcagcagcagctggaggagggagggaaggctttgtgagggatgcgggcctaggctagaccttgaaggggggagagggggaagcaagggggagatttggctcagcagaaaaggaagaaaagacgcctttctctctattccctggccacgaactgaccttcgaagcctggatgattgtttggcaaatgtgtgtcacataaaagaccaggtcagctagtgtgggtggctcagtgcaaacccctgtctccactccgggagatataaactggctggccagcctgccacccaagc

SEQ ID NO: 138949 - DNA, 1053 bp, Homo sapiens
tttggtttttgttttttaattcagggtctcactttgtcacccaggctggagtgcagtggcacagtcacagctcactgtaatcttgaactccttacctccagttctttttttttttttgagatggagtttcactcttgttgcccaggctggagtgcaatggcacgatcttggctcgccgcaacctccgcctcccaggttcaagtgattctcctgcctcagcctcccgagtagctgggattacaggcatgtaccaccacgcccggctaattttgtatttttggtagagacggggtttctccgtgttggtcaggctggcctcgaactcctgacctcaggtgatccacccgcctccgcctcccaaagtgctggattataggcgtgagccactgtgcccagctacctccagttcttaaagcctggctgtctaggttgaaatcccagcattgttatttactagctatgtgatcccagtcaattgtatgccccagtttccttatctgtcacatgagaccactttataacactttggtgaggatcaaatacatgaatgaatacatataagatgcttattagaacagcacatggcacacagtaagtgctagctgcccttacgatattgcctaatgcagcgcctaaaactcagattcaattcagcaaacacttgctcagagccggtcctagtaccagaccccaatgaagtggcagtgaggaaaacatggatgtgaggaagacaccacctgccttccgggattgtgtgtaccttttcgtgtgggctggagtcagagcaggtgtacaggaaggggtcagggagaggggatatgtcatctatataaataattgtaattggaagccaggatcaaattcctgagccagtgtgggggatcaagcaccctagacttgggggcttctctttgcctgaagaccctggccagattctggtctagatgcacctcccaccctccccacacacagagtcttgccctaggatttgggtgaatgagagggaaaggaacactggttttcttttcttttcttttcttttctttttgagat

SEQ ID NO: 138950 - DNA, 1074 bp, Homo sapiens
gagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaaggtaggtgcctgtcataactcttagaggaagatgggaagtacggcttagaaacattcctgtaacttcatcgggtgccctgagatgcattgtcccccggccaggtcaaattgtgcctgagcagaacaaaggtatagccttggctcaggaacattctttttcacttgggacttggctgggtgacctgggagttggcaggctgcttgtttggggttagtagagaactgttcccacaactccctcccagtgtgatatggggactgccccaggtagccccattgtgtgggcatggcctgaacgcaatggagtaagttagggacctattgttactctctctccctcagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaattctgttctcttgtcaagggggcaggtgggtgaaggtggaaagccacgcatattagaaagcaagcaaattgcagcaccgaccaagcacaggatttttctcagccatgtattcatgccctactccagacgcaaaactcctttcatttccgaacttccctcacccctccagacctctttgcacacacctgctgtggcctcggcccacaacacttgactcccctcctctcctctcaggaagttcactatctctgaagactttcccagccttccaagcctcatccttgtgta

SEQ ID NO: 138951 - DNA, 1020 bp, Homo sapiens
tccctagatgctctagcaacagcagatcagttggcatctctcgtgatctgcatactaagttctttggttggcataagagtgcggtgttggtcgggtgcggtggctcacatctgtaatccctgcactttgggaggccaaggcgggcagattacttgaggtcaggagttcaagaccagcctggccaacatggtaaaaccccgtctctactaaaaatacaaaaattagccagggtggtagtgggtgcctgtaatcccagctactcaggaggctgaggctggagaatcacttgaacccaggagggagaggttgcaatgaactgagttcgcacccattgcactccagcctgggcaacgagtgaaactccgtctcaaaaaaaaaaaaatgcagtgtcatggagaatatgtgctaccgtgtcattccttacagtcccttgacagaacaccctcttctctcttcttaggagtgatttgggccccgatgttggctatgaagctattggtcttgtggacagtagtttgcccacagttggtgtttttgcaaaagcaactgcacaagacaaccccaaatctgccacagagcagtcaggtaagaaagtcctagcactcctcttggagagtgttgagaagcagtggtccagattctcctgaacaaggggtttctgtattggccagaggggcttgtcagtgaaagcctctcttcatgttgtgctttaaaagaaaccaaaccccaagtcctcactctttagtggtctgagatttggcaaaatcaggtatcctggtcaaagcatagattcaaatattgtgggtatctgtcctagacagtggacagtggctagctcaatgacactgctgttttgtgtgtctctgggaagacctttctaaggaagaaaacaagaaaacctgaactttttagattgcgtttttatttttctttctttcagttgtcatttttattattttgcttcaggcgaatctcaagaacacggcctgataggcttagcttaagactggctatcctcca

SEQ ID NO: 138952 - DNA, 2082 bp, Homo sapiens
attctgctcttttccacttaacaccataaatgtaagcattttctatgttgcttcagactttgtaaacagtttaatgactatatattccattaagcgaatttcacagtttacggttgctcactcgttggatttttaggttgctttgggggagtctaaatagccacaaagatgaacaaagggttagagagctcaaatgccacatccttcatgaagctggtccagttcacccccggctggaggttctcgccctctgcttgaaatacttgactcctttaatctgtacctctcatatggcacactactgtttacattgctctgtagttgtgagcaaggctgtatctttctgtactaggttgtatgctcctcatagtcaaggtccatgtcagttttgtctcagcaacccggacaacataatacttttgtatataataagtactccataaatatttgtcgaatgaatgaatactgagtgacaaaaagaaatctaagaaaacatttctaggtgagaggcagtcacatccaaaaactggtttctacatatagaaaagaatattctgcaaatcatggttattaaatatcctgtctgttaaggaaagaacaggaagtagacataagtaaacaaaactatagaagatttaggttagctttatggaagcagaatagatttttttttctttttttttttgaggcggtgtctcgctctgtttcccagtctggagttcagtggcacgatctcagctcactgcaacctccgcctcctgggttcaagccattctcctgtctcagcctcccaagtagctgggattacaggcgcttgccaccacacacgcctaattttttgtatttttagtagagatggggtttcaccatattggccaggcttgtctcgaactccttgtgatccacccaccttggtctcccaaagtgctgggattacgggcatttgccactgcacctggcctggaatagatgttttaaaatgagatctcaggccaggcgtggtgactcatgcctgtaatcccagcactttggaaggctgaggcaggcacattgcttgagcccaggagttcaaaaccagcctgcgcaacatggcaacaccccatctctaccaaaaaaaaaaaaaaaatttagccaggcatggtggtgcattcctgtagtcccagctacttgggaggctgaggcgggaggatcatctgagcctggaggtccaggctgtggtgagccatgatcgcaccactgcactccagcccaggcaatagagtgagaccctgtctaaaagaaaaaaaaaaaatttaaatgggttatcagctgtttttgttagtttaagtacaactctggcctgtagatggaaaacatgaattagttaccattacaagtgttctttgagcccccaaagtttatattttgtctttaacttgctttttttttttttatcatgtgttcatgttatgtatttgtttccacaggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggtaatagtggtgtgccttggagacccaactgattacaactcagtatctctaggaccataacacagagttatggtttggttttattatgagccagttagcttcatacagaagggaaaaaagtccatcttatgtccacacattctaccctcaggtagccatctggcagaagtgtcctgtttagtttttcaccaaactgatccttttgtaaaacattaaaagagaaaaaaattattttaagtgttctgtctggcgtatgttagactaggtgaatgaatggagatggcaccagcacttccggcaaaataggtcagaggccgaggtgggcggatcacgaggccaggagtttgagaccagcctgaccaacatggtgaaaccccgtctctactaaaaatacaaaaattagctggacgtggtggtgcatgcctgtaatcccagctactcggtaggctgaggcaggagaattgcttggaccc

SEQ ID NO: 138953 - DNA, 1999 bp, Homo sapiens
cccagcttgagagatctgtgagctccagttggaatgtttcatggcaactagttttcttaatgttctttttcagatatatgaaatcagggcatcttttcaggaggatgcttcctattcagaggttgcaaagcacttatgtaagccttaggtgactgcatgggtggaagtgcacagagttcaccatctgaagcttaatctggggccagcagttctgatacctgttgtatttgcgttacaaatgaacttgagcaccgaggccctcatgcccactgtcctgtaagtgggcgctcggcctggattgcagctctgccctgtctgtagtgagggctgcctgctgctcctttacttctcttcctgtattcctaggattgacttttgcttcctgctgtaactactctgtttcttcttcccagctcgagccttgggcacagaagtgattcaactcttccccgagaaaggaaatatgggaaagatcctccccgaatacctcagcaactggaccatggaaaaagtcagacgaggtagagagactgtttctatatgctgccactctatttcctttgagtgtgacctaaggcaaacttcgcttctataggaacccccttgacataagccctatcacctggcctgtaaaatgtttccaccattctccagtcagctaagttcatctaggtgttctgaatcagatgccccaaattcctggaagtgctgaaaatgaaccatgggtgtaggttcttgcagctctccaaaactgcctgtgtactgataattggttttaccgtggaggagaccgctggtcagctttcctacttcccatgaaagtgatagccttgtaggctcactctcaggtcttgtttgcctttacagagggggttaaggtgatgcccaatgctattgtgcaatccgttggagtcagcagtggcaagttacttatcaagctgaaagacggcaggaaggtaaggaaggaaaagatagtctgccaagaggccttccagttctccactccccttgcctcatttttactccttcatttgacaccagtagattagttttcctggcagttgccattaacctgatataattttccgaattaaccatccctccattaaaacagaatgatgagagccagagtaggctcctgtgaaccactttcccttagccccattctatctgtctcacagagttttgagtcctggctagggtggcagatttctgttcgaatgacatgggggatgtgcatgggatggggtggtggaggcttatgaaatagaacttaaaatccatttatcagaggtaagttaacccatgattttttaaagtcccaattcttaatggcatgaagggccattgttacgcctgtaggcataaatggaaactgtggtaattgactgaattatttcttttttgcctcaggtagaaactgaccacatagtggcagctgtgggcctggagcccaatgttgagttggccaagactggtggcctggaaatagactcagattttggtggcttccgggtaaatgcagagctacaagcacgctctaacatctgggtggtaagtgtgctacagcatgaccaggcataattcattctccctagcctgtgaacaagtctgcccggtggtgtgctaaagctcatcaacagcctaaccaaatagggtcagagtgtttggaggctgagggtacagaatagaaatgtgtgaactgcttgattcagaagaccaggtatggcctcatctgcaagctagtggcagatgaaatgaacagtgtgcatgcctgcaggggtagagctcttccggttctacttattggcagcagctactggcataacccctggtgggcatgcacataagccttcagatggatctgctgttccctttgctcaaacttgaatccggaggatggaggatgaagcaatgttataacctgttccctagaaaggaaaattactctgttttcattttccttgagtactatttttagctgttttttacaatctat

SEQ ID NO: 138954 - DNA, 1104 bp, Homo sapiens
accacgaccggctaattttttttttttttgtatttttagtagggacgttttaccctgttggccaggctgtgtactgtcttttaagttcttcctagaacaaggcttgtcagcctctgcagtattggcattttgagctggataattgtagtgggggctgtcttatgccattgtagtatgttagcagcatcctggcctctgcacactaaatgctgggagcacctacttgccctgacaaccaaaaatgtcttcagatattgccagatgtcctcctggggaagatagggacaaaactgccaccaattgagaaccactgtttatagaaggaattttaccatgaagaaataaatttgcattaataacatagaagttataattgagtcactttatacaaggagaaaatttacttttgccaaagatttagaagaaactactttctagtattattatcctatgccccttttggaaattaatggactaaactgatgtgatcctgcagattggagactttagaagcttggagaagatttcacgggaagtcaaatcaattacgattatcggtgggggcttccttggtagcgaactggcctgtgctcttggcagaaagggtgagtattgaggagtgaccttgattttctttctctagtcttatatagcttttctgtgaatcccagagatgtgtttggcaggatcagtaggaagagtttaattaaggtttatttatttatttttttttgagatggagtctcgctctgtcacccaggctggagtgcagtggcgcgatctcggctcactgcaagctccgcttcccgggttcaggccattctcctgcctcagcctcccgagtagctgggactacaggcgcctgtaaccacgcctggctaattttttgtatttttagtagagatggggtttcaccgtgttagccaggactgtctcgatctcctgacctggtgatccgcccaccttggcctcccaaagtgctgggattacaggcgtgagccaccacacccagcctaattaaggtttatatagtgaaaagctaaacactgagattagttctggtgagggatcccttggtgaccaaaaagctgtcacctgagcaac

SEQ ID NO: 138955 - DNA, 1052 bp, Homo sapiens
tttgagacagaatcttgctctgttgcccaggctggagtgcagtggcatgatctcggctcactgcaacctctgcctcccaggttcaagcgattctcctgcctcagcctccccagtagctgggaccacaggcatatgccgccacacctggccaatttttgtatttttagtagagacggggtttcgccatgttggccaggctggtctcaaactcgtggcctcagtgatctgcctgcctcagcctcccaaagtgttgggattacaggcatgagtcactgtgcctgtcctgggctgacaacttcttattgacctggagttttggggtggtgatggaaatgttctgaaatcagatagtggtgatggtggcacaaccttgtgaatatactgaaatccacagaattccacactttaaaatggtgaatttgatgtgaattatatctcaataaaactttttcaatgctaattcatctctacctcttttgtgtatgtgtgtgactgtaccaggtagtacagctggatgtgagagacaacatggtgaaacttaatgatggctctcaaataacctatgaaaagtgcttgattgcaacaggtgagcatttctggagatggctttcttccctgatacagctcattcaagttttagagtccagccttctctatggaaggcattactacttaagaaaatggaaacccagactctctgaagtgagtgtcttctcttggtacaaaagctggctgtgtcaaagcatcctggatcaccagcccttctggatgatccttgctgttctcccggtagaggcatgaagaagttgcccttttttctctccctgcttaaccctcaccctgtgccctgtgccttgaaagtgatgtcgtttgtggcttcattgccagttgcaatcagaaaccaagagaggagacagaagcaatttatcaaacccatgtagctatgctagctggcaaatcctcatgagaaactagaagagaacatggaagccaaaagtaaggccttttggccacctaggggcagggtgtaccccttgaagacagactctcaa

SEQ ID NO: 138956 - DNA, 1768 bp, Homo sapiens
ctcatagtaaaataatttgggcataactcagcacggaatatattgttagactttaaaaggtgagtgtctgagtaataaggtcagttattagcaggtatttgtggagtcccaggatggttttgttatattttattgttgttaatggcaggtactagagtgtgtgtgtaaactaatggcagtgttccaatagggacgcattctctgaaggagcaaagcccagagtagatgagatacacagcataagtggaaggattgtccttcgttaggaacatactcacttctcctgtaaggggacattagacagagaagatggatataggtttgttgataagccggtaatgagacatttagtgtcccctatgtgtaaacaacattcaggccctgccctctaggggctaactgtattaggcagaaacataaatacataatcataacacataggtgtgtagtaagagagatctgcgcagtatgttgtgggaaatactgggaagggtgcccagtagagtgatgacatcaggaaaggctttctggaggagaaggtcttacagaatgggcaatcttatggaatgaagaggcattcaccagactagagaagactgaagagcatccaagtaaaaaagaacagcataagcaaaagcacaagggcacaaaaaagcatgtttggtgccaggaaatagaagcagctcgatactgatagagcagttaggtacaagttaggaagtggcaagagatgaacctgagaagttatgcaaggggcctgattgtggagggctttgcgtgaaagagctttttctgcactggggagctgttgcattttaggcaattgaattttaaataatcaccattggccgtgaggaggatggatttcagtgagacaagactagagagagaccatttcagagattattgcaataatctaggcaagagatgatgagagcccaaattagaatagtagtggtatgatgatgatgaagaagaagaagaaagtaagaggtaaaatttgtatagtacctattctaatcttgtaagcacagttcttaaatgctttatgtgcaccatctcattttatcctcccaataatcttatgaggtaggtattatttccctcttacagagaaataagttgaaatttttaaaaataaataaattttaaataatttgcctaaactcacatagctagtaagtggtagagagagaatttgagcccgggtctgtctgagccacagaattggaacccagctattctgattccagagcctaagctattaataacatcagtgtacagtgtacagtactttttttttttgagacagattctcactctgtcgcccaggctggagtacggtggcatgatctcagctcgctgcaacctctgcctcccaggttcaagcgattctcctgcctcagcctcccaagtagctgcatgcgccaccatgcctggctattttttttttttgtctttttagtagagatggggttttaccatgtaggccaggttggtctcgaactcctgacctcaggtgatccacccacctcggcttcccaaagtgctgagattacaggcatgagccatcgtgtccagccagtattacttcttgatagaaaggtgatgagaagtagggaacacacttgaggcatgcttaggagtcatgcttgatgaggcttggtggttggttaaaggtagaagatgaaggagatggaggaggcaaagatgattttctaatttctagcctgcatgtctgagtggatggcagtgtacccacagctga

SEQ ID NO: 138957 - DNA, 1029 bp, Homo sapiens
tggagtgcagtggccgaatcatagctcactgcagcctcaaactcctgggctcaagtgatcctcccacctcagcctcccgagtagctaggactacaggtgcgtaccaccacgtgccttttattaattaaaaaaatttttttctagagacgagatgttgctatgttgcccaatctggtctcaaactcctggcctcaagtgatcctcccaacttgggctcccaaagcactggggttatagacctgagccactgcactcagccaatattaatatattaactaattaatattaatatatcatagttgataactgcttgaggcagagtcttctcaggagctataattagttgttccattgaagagcaccattctggacaacccatttgggtggatatgtgaataccagctctttgggtgctccacttgttcttactttgaaatgaacctaaatctagagcaggatcctcagcctcagcactattgacatttggagcaggataacgctttgctgggggtggggagctgtccagtgcatcataggatgtttagcagcatccctggccattacccactggatatgagtagcatccctacccaagttattacaacccagattgtctctggacactggcaaacatcccctgggagcaaaattgccccaagttgagaaccactgatctggatacctgtatgtaagcaagtcatgaccatgatttaatagacttggagacttactttggaaaacgtcccttaaagtttctgataatggaaacagttttattaaagctacgggggaagctgataacagttccacatgcttataatattctccctctcttctccatacagcatatatttccagccaccttctttctatgtctctgctcaggacctgcctcatattgagaatggtggtgtggctgtcctcactgggaagaaggtgagctagtagaccgcttcttttgtcaggctctacgtacttgcccaccagccagtatggtgatgtgtgtttccattaccatttatgtctgtc

SEQ ID NO: 138958 - DNA, 1049 bp, Homo sapiens
tatagattagccctttctagcactttattcttctagtataaaatgattttttcttttttcttaaactgtaccttcagaataaaatatggggagaattctttatagagagcctaaaaatctgaaactggaatattttcatctgcttacacatattttttccataccaagcatgtgcacacccagtattttttatttcttaagaaaacaactttgtcttagtggttttgacatagaggaactaacatcagatagacaaaagcttctcatttaattgaaagataatattacttacagtatgagctagctgtatggtgaaataaactttctccatgtttggatccgcaggcctacaagactatgaaagaggatgaaaaaagatacaatgaaagaatttcagggttagggctgacaccagaacagaaacagaaaaaggccgcgttatctggtgagtattcccttaagtcttgctatgatttgagactcacaaagggaaagttataaacagtttgggtgctgtgatttatggatgtcttgtagaagcaatggtggtatgagattgcaagcatctagaaagtatggtattaccctagaactgggagtgatttaaagcatttggctgaaatttgggtttgagaataaagctagtgataattatgattggttgtttatctgtatattaatattagtctcttggctgggcacggtggctcacgcctgtcatcccagcactttgtgaggccgagatgtgcgggtcagctgaggtcaggagctcaagaccagcctggccaacatggtaaaaccccatctatactaaaaatacaaaaattagccaggcgtggtggtgcacgcctgtaatccctggtgctcgggaggctgaggcatgagaatctcttgaactgaagtggcggaggttgcagtgagccaagatcacgctgctgcactccagcttgggtgacagagcaagactctgtctaaaaaaaaaaaaaaaaaagtctcttaaaaggcaagcttagcaaggaaaactattggaaaagatggaaaagagatga

SEQ ID NO: 138959 - DNA, 1756 bp, Homo sapiens
cagctaatttttaacggggtttcaccatgttggccaggatggtctcgatctcttgacctcgtgatctgcccacctaggcctcccaaagtgctgggattacaggcgtgagccaccacgcctgacctacattttttaaacggctgaaaaaaaaaagaatttcgtgacacatgaaaattatataaaatttaaacttcagtgtccataaagttttattggaacatggccacatccattcatttatgtattgtctttggctgcttttatgcagcatcagtggaattgagtagttgcagcagacaccaaatggcccagaaagctgaaaatatttaccatctggttctttgcagaaaaaatttgctgctctaggttgatagtcaacaaacacgaggagtaatcacagaataatcagagactgagaccttcctttatctgaaaatgtcagcgtctccctagaaaaagaaatctacagaactcttatatttctatgtacaggtgctgttatgatcatcacatcattacatagctctgcatagttttacgtcaaaataacctttgtattattttggaggagtaagagtcaaggagttgctggacacttcacattttgtcattataaaaaatatttcatagtccaaaattttttagttctttgggggagagaaactcattaaaatttttttttctgattttcttctgagctttaacatttctgtattccaggacacattacctttcatgcaagattgaactgtgtcctggttagagtgttgcgttttattttgtgcaagattggaaccatctagattactccttaaatggttgttataatgtcccaggtagcccatggttaactttgtatatctacctattcagtcatctctctgtgtttacttaatttatgggaaagacatgaaggaagaggtatttgatgaactgttcgtgtttttcatgatcttttctggaagctgaaaattttctcactggacagcattaaattttactcttaaaaacttcagcaacttaagagcgttcattcagctgtctgtagtatttatatatgcagttttgatgatatttttcttgatcatttaacggtgaatatctgtgggcaataagtcttgtacagtgcattgacatttaatcataaatatgtattaactattttatttttgtatgtgtgtgtcttaataaattatgtttcttaggcaacttgttccagcgatggcatgttcctctagaactccagatgacaagacaaatggctagctctggtgcatcagggggcaaaatcgataattctgtgttagtccttattgtgggcttatcaacagtaggagctggtgcctatgtaagtagaaaagcagcgtgtataaagaagctgccaaacagctcccattaatagactcgatagtattctgctttaaaacttttgcaactaattcccctttctccttttggaaaaattttcaaaaagccttctcttaagtgcctgctgcctaatatcttatgggagccaattctggaatgactgaaatttaatctcatgttgattgatttctgctcttttcacttgtctttttcttctttacttgaaagccactatgttttcctagattcgagtaacccacaaaattgtacctgttttcttggatgtcacacactaacctgtgaataaagtcaaaatccattgcagctccttagcacaatatttgattttgacctatttgtcagacattttatttcctcagcttgaggt

SEQ ID NO: 138960 - DNA, 2281 bp, Homo sapiens
tggtgtcctaaaaccaaaaaacaaagtgcgatgccggggctacgctgttgtgagatgctgttatcagttctcgtcaccaacacagcggcagcaccaggcacaaccgccaatcaaagcggccccacgagtccctccttgaacaggttccttaactcgttcagtccaacactgtgccacaaactcgcgaaaaccggctacctagagccagcgtctttgcgagcttgcggccagctagtgcatgcgcaaatcctctcgccgtgcggaccaatcgcaatgcggcagcgagtgctacgcctgcgcagtaggcctccggtcgccgttccccttccccggctctagcaggccggcttctctgtccaatgcccacccggagctgggaggaggagtctgcgtaatgtgcgtgtgaagagactgggggagctggccggggctcacggtgtttgacccgtcggtcgtgcgtgagaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccaggtgactgacccattccaggcaacctccaagtccgagggcctggcgccttaggctccctgtgccttgcagccctctacccccgcgtccccgcgagaaacttaacacatagtcacgtgaattccaaattggcagactccgaaccctgagtcttgcaagcggaggaattggctcagccatgccgacctgaccttcaagagatttgaacccagtagtcggcttgaggccttttcccgggagcgtttgctgttcagggatcccagaacaactggctgtcggcgcctccccggcatccccaccccccacccccctttttagagcaatgaggtcaagtagactttgtcatttaccgattgagactttaaacaggacgtttaagccctacgcctaagtttcttgtgtaaatgagggtgttatctgctcagccttccaaaccacagatgagatccatggatttgaatgcccagtgaaacagaaacggtgcagggcaagtaaggagtcggttggttgtgtaccagacacccagagaattggcccagacttaattggagatgcctgagccgtgtacttcttggtggtctttaaggcttcaaagaaacagtttgcagaacgcattgtattttgttctccattaagttgtttcatcaaattttagagctggaagggattttgtggtaaaggtcaacccactcattttatagataataaactgaggcacagagaggtgaaattacttgccaaaggtcacatagttaattaataggtagagctaaggatagtttgctagcctccaggtccttaatcccttcgctgcaactccatactgcttcctaaagttgacctcaaaaagttaagaatgaattcgggtctcttcccagtaattagcccattgtacatcagatatccgtgaatttatctgagcatggcttgagcctgcttcttttcgtactgcgttacttcatgggggcaatgaatgatccacctgtaggagttgctttgaaaaaaaaatcagtaatccttcaatgtccacccctagggcatttgcaatgtcagaagttatccttgaggcttttacaatacagaaacacctgggtgctttaaaaataaaaagtggaaaatattttccttgggttgttagggtctttgcaaatgtgcatttgaacagtttttccagttgctatgcacaatgaaaatgtttcctgataggtgtatttgagttatgtcctgggacatactgctcttggaacttaaaacctctgcttagcttttaaactaatgccttatcaatggatgtcatctttgagggttttgtgtattgaaatgatggtgctctgtgcttgttgcacagaaattgagataacctgaattttttttttttttttttttgagacggagtctcgctttgtcgcccaggctggagtgcagtggcgcgatctcggctcactgcaatctccgcctcccggattcacgccattcttctgcctcagcctccagagtagctgggactacaggcacccgccaccacgcccggctaatttttttttttttttttttgtatttttagtagagacaaggtttcaccatgttaaccaggatggtctcgatctcctgacctcgtgatccgcccacctcggcctcccaaagcgctgggattacaggcgtgagccaccgcgcc

SEQ ID NO: 138961 - DNA, 1048 bp, Homo sapiens
ggcacggtggctcatgcctgtaatctcagcactttgggaggccaaggcgggaggatcacaaggtcaggagttcaagaccagcctggccaacatggtgaaaccctgtctctactaaaaaaaaaaaatacaaaaattagctgggcatggtggcgtgtgcctgtaatcccagcttcttgtgaggctgaggctggagaattgcttgaacctgggaggcggaggttacagtgagccgaggtggcgccactgcactccagcctgggcaacagagcacgactccatctcaaaaaaaaaaaaaaaaaaaaaactcataagtcaaaccattgtaactcgaggaccatctgtatattatatatgtataacgtttggctctggcgtgacagagtagacaatgaataaacaatgctgatgttactgctactcctgctgctgcttcagctgttattgctgttaattctgttactgctgttactatcactactgctgagaccctggaaacaacacatcagtggaatcttctctgacagttttagtggcaatccatcaacattgtggttattcataactttggcttataattcccaggtcttgaagtacattccttcaaactgtcgggtggatgacatcttatcacagtgcttcaattacatgtggcataattctctaatgtcggaaatgagcgtagctctggctttttctgtctaaggactacgaaatgacactgccttattgaaaactactacggaatcctgtctgctctggagggaagcattccttttgtgctaaagaaccccttctttaaaagaaacttctttattcattattaccagtaattcacttccagaaataaaggaatcttgaatcaatgaaatcttgggtacttattcaatacaattaattatatgaaaacgtaatttttttttcttttttttttttttttttgagacagggtgttgctctgtcacccaggctggagtgcagtggcacgatctcggctcactgcaacctctgcctcccgggttcatgcgagtctcctgccgcaacctcctga

SEQ ID NO: 138962 - DNA, 1046 bp, Homo sapiens
gcctgccaccacgcccggctaatttttaattttttgtatttttagtagagacagggtttcaccatgttagccaggatggtctcgatctcctgacgtcgtgatcagtccgcctcgtcctcccaaagtgctgggattacaggtgtgagccactgcacccgaccgatactcacatttttaaactttttttttaattttattttggtagctaggttttatattgttcttaaatttattttactctattttatttttccatcacttctttgtcccagattcatgaaatttgctgatgtccattttatgtctacttttgaactcttctctttgtgtttgttttgttcttattacaaactccaagacatttcttagaattgtctacagatttcgtgtagctacttattggtagcttcttaatttcatacttgtccagaccattagacattattacatgctctgtcttgggcctatcattaacattagcttagggattctgatttcaaagacataaagaattggcaaaactcttcttacagaacttaaaacaagttttaaagttacatttctatacatctaatacataataccttcttagccattaatgtaattcctctggataaagataatatattcaaaaaatattgggaccaaaaaatgcacttgtttcttgctcatatatatatagatgtatattttttttaatttcttgtttgtttattttggttacattgaatacagatttgctgaacagttttgatgttatttttttaataaaatttgtattgttaaagtgccttggaaatttctaataaataacttcatataaaagctatcatataactataggagcattgctttgctcctagttccgtggagcctgattgcttgacctgcagactgaaagctttatctgctgagcacatcttgtactttttcctccagcacagttaaaagcaaactatttacactttactaatttcttgagcagctagcaaaagccccctttgtgatcttaatagtcatgaaggtgggcaggctctgaagtcatt

SEQ ID NO: 138963 - DNA, 1149 bp, Homo sapiens
cccatgtattaaattgatagtctcactcttcatatatgctattgtaaatgtaaaactcttttgatttcagtttccaaaagtacctcaacttctgaacccactactgggtaagtttaattttccttcagtgcattttgctttgatggactttagcactgttgtattttttaatgaatcattaatattaatataaatgaaaaatattaaagtttttttttttttttcttaaagctgctcattgaaatagattcctgctccatggagttcatgcaacctggtgcaagacaagttggaagttcctaagttcaaagttctgaagtattttctcacacaaagggcagttaaacagccaagtttatgacactagctctcattattcagctcttttcagctttcagatgccactacattgttattccaccttatctttgcgtcaggttaacatatcttaacatatttttttctccagttggctctctccaaaaatgccttttgtttttctctgctatacttgacttgccttcagaatattacattccagataatatgactgttcatctttttctgtctgttttgtctgctttcttaatttcttataagtcttacatgtttaggtcagataaccattttttcttcattccttgttcattactgttctatttttcatatttttcaaatgaagaagcaacacataagtttcaaaaaatatccagggtactcctggacagtgtccccttttgatggacacaactgatacctgttctttctttccaagaaatgtgaattatttgactgtgagacgtcctctagtttgtggccttcagaaatcagatcttggggagagtcccttcctacctgactgacctcccataaggctgatgctgatttggccagagatgacctcaaggcccaccaaatagagcacaacttcccattgggagctttggcttttgatcttaagcttatgggtcgattctaaccaagaaaagtccatgagatcagtgcttcaacatccaggttgacgtttaaccattttggctgctgctctttaattttcctctagcaggcatgcagtccaaggaatatcaaaattctgattgtatgggaaccaaggttactttcttgttcttggataaagaaaatttctac

SEQ ID NO: 138964 - DNA, 1507 bp, Homo sapiens
atatgaggtaagggttcaaattcattcttttgcacatggatatcagtttttgtagcagcattcatcaagactattttttgccccattggaaatgttttgggacccttgccagtttaccgtaaatgtgatatttacggcttacaatgatatttttaatactaatgcgatggttacttttctaaaaatatgtattggctttgtttttataggttactattcgagcttcacttggacctctccagtcaaaattaccaactgcacctttcggttgcgctccaggcacttcttttcttcaggtcacacctccgacatctcaaaatacaactgctagaaatcctagaaaatctaatgccagtagatctaagacaagtaagcttcatgcaactacatccactgcaagtaaagttaatacaagtaagccaaggggacgtatagctaagtccaaagcaaaaccctcttacaagcaaaagcgacagcgcaacagaaaaaataaaatgagccttgctttgaagaacataaggtaatatcttttattcctgatatacaatacaaatttaatcttatgtatataatttatcatatcataaaaccctcttacacatttacatgataatcacttatctggcataaagaccaagcaaatgagaaaaaggtactttttacaactgctgagcagaacttgagtcattgtgtttattctctaattttcatcttttacactaaacttatattttgtgcttttatcttatgatagattaattggtttatttgatcccttttattccagggaaatgttaactggtgttaaattttttacacttactctagcttgtttcaaagcaaattttgaaattatgagtctacttaaagataccaatttaaacattttggcttcagttaataaaatgttaataagattttcccctgttatttttgttttataatctctttttatcttttttttccgtctccataaggtgtcgtcggggaattcacaagtgcattgaatgtcattccaaaataaaagattttgcaagccacttttctatatacatccactgcagtttttgcaagtacaatactaactgtaacaaagcctttgtaaatcatatgatgaggtaagttaaacatgtaaactgccaatcagaatttccatttgggtcatttgttttttgaaaacagagttatcctattgaaagcaagtttgtctcatcaaggaactaaaagggtctagcaatagggaacttctaagatgttccttgtactattttccagcatagtaactcataaaattactgggacaaaaactctgagaacaattagactaatgaaattaaaatgagtttgttagggaaatttgttttttctatgggacttttttttcttttatgtctttcaaaaagtggttattttttaacataaaatgttaagtgttttcaatatatttatcaaataaatatgatcagctcttgcattccacatctgtggattcaaccaactgtagata

SEQ ID NO: 138965 - DNA, 1113 bp, Homo sapiens
tcgttaatatctgttaacatacaactgttatcaatataaaactaatattacaacagtaagtaaatatcaagataaatttcatttaatcagtatgaccatttagaataagtagaaggcttatctgattgtagtttatacttgccattttcaaaataatgattttaactttttgtattgcagtggttttttggtaacagtgttattgagatataattcatatatcacacaatttacccatttacagtgtacacagttcagtggtttttagtatattcagatttgggcaaacatcactacaataaattttaaaacatttttatcaccctcaaaagaaacctcataccctttagcattcactatttcccctccattagacctgtgcaaactttagtctgcttttagtgtctatggattttcctattctggacgtttcatataaattgagtcatacaatatgccatctttagggactggtttctttcgcttagcataatgttttgtaggttcattgatattgtaccatgtttcagtacttcattcttttttgtggctgagtaatactccactgtatagatattctacattttatcctttcatctattggtgggcatatgggttgtttcctctttttggctataatggtgctgtaaaaattcatgtacaggtttttgtgtgaacgtatgttttcatttctcatgggtatatacctctgagtagaatggctgagtcaaatggtaactcttacctttaatattttaagaaactgccaaactgtttttctttttttgttcttttgttttgttttgtttttgagacggagtcttgccgtgttgcccaggctggagtgcagtggtgcgatcttggcacactgcaacctccgcctcctgggttcaagcaattttcctgcctcagcctcccgagtagctgggattacaggtacctgccaccatgcctggctaattttttgtatttttaaaagaaatggagtttcaccatgttggccaggctggtctcaaactccttacctcaagtgatccgcccacctcggcctcccaaagttcagggagtacaggcctaagccaccacacccagcctgccaaactgtttttcatt

SEQ ID NO: 138966 - DNA, 1003 bp, Homo sapiens
agctatgggcaagtgcaaatttctcttgggtcccatttcccattggtaaaataataatggggctaggtttgaggagggatttagtcaagggtttctcaaacaatagattgggatccactcgtatttatgcctctataatcagtatagaacttttccaattaaaatctaattatatactttttatgtttgatccttatatggtaactaatgcttttgaaactcaaatactaacacaaggagtacttttaaataatagatcactttgaattgtctgtggtgggagatggtaaaattctggttgtaaatttatttagattttagaattaagagcaatttcagctcctaggatttgtggtggtggaagttattatatctaatattttctgtaaacagaaaaaaggagttcatcgttgcccaaaatgcagactacaatttttgaccagcaaggagaaagctgaacataaggcgcagcatcgtacatttataaagcctaaagaactagaaggattgcctcctggagcaaaagtgagtttgtgagggagtttttggtggttttttgcacattctattaatttttttatgtttttttttttattatggatagaaggaataagatctagtgttagaaagctcactagggcaactatattaacaataatttattgtgtatttcaaaataactaaaagagtggaattggaatgtccctaacacaaataaatgataaatacttgaggtgatggatacccgttaccctgatttgatcattatgtattgtatgcttgtatcaaaatatcccatgcaccccaaaagtgagttttaaatatgctgtatttttaacattttgtatgataatagaaacaaactactgcctggttttatctattgaatataatattaaaattgacctctgattgttattaagactttaattttaggttttatcattcttatgcttgtaaagaaaaacttctaaccattgttttttttagttgattgatgtgg

SEQ ID NO: 138967 - DNA, 1033 bp, Homo sapiens
tatagaataccaaattaaatgctttgggatcagtgttccagaatttgaagtggcttccagtaacgaggaattgagatgaagataaattgacactggcatagcatggatgctatttaaaatctaaagaagagaatactctgttttatatagcaggaaaagctttttagaacaatatttggcagaggttgaaaattcacatcaagatagggggtggtagatttgaaaagaagaagagagtcttactgtgttttggaatatatgcctaaactttgaaagatatctttcaaaggttatctttattacttgcagtaatatgattcttggttgtataggcagcagagctggactagtagtacatgttcttccaaacagatgacccgttattgctactttgattgtaattgcaagaagttataaaatatcaagttaaactaagccttctttatatttctaggtttgccagtttagatcatcaacattttctgatgtagaagctcattttagagcagcccatgaaaacactaagaacttgctatgtccattttgcctcaaagttagtaaaatggcaaccccctacatgaatcattacatgaagcatcaggtgagattaagcagttcttatttgttcatgttgtcttagtgaaaagatatagatctatatgtatagatctatagctacatctatatctatctataacgtagaacattggttagatttgttctggacagaaagcaaagttgttctgaatgacacaattaatttataatttatgctgaataacttgtgaaactttcacttattttccttgcttgctttctggtgacactgagaatcataaatagtcaaagttctgaaagatagctagaaataggaaccccaaagtggaggaaaaaacagaagattcatgaaatatttaggttagatatttcaggacctaagggtggtgggactgggaatgactttgaaggtgcttatcaagagcaggaaaaagaataagtttgaatggaggaacataagattaaggactcataa

SEQ ID NO: 138968 - DNA, 1050 bp, Homo sapiens
tgaaaccttcagagctttcaaagatttgtctcttcactgtagctgcttttggtggtagagtttccatcctttcagtattttattttaaaatgtaaatagtatttcatgtatggaaaagaagcctgctatttttctttgctaaaaaaaattttaaatctaaaataatgatatagtgttacagcaaattagtgatgtttcatactactacattaatggattattttagaaacaaagataaaaaaaccttactgagccacttaatgaaagtaaattatttaaagtacacactttatagagtgctttcaggccttggagatgttattttgagtcatagaattacattttaaaaatttattttcagagacttatttgtgaggtttttctttggttataagtctgaatttttgctcttactggcaaattgtttgtaggtttatgaaccacatgaaacatcacttggaacttgagaagcagaacaatgaaagctgggaaaaccacaccacctgccagcactgttaccggcaatatcccacacccttccaactgcagtgccacattgagagtacacacactccccatgagttttctagtaagtgaaagtttctttggaatcctgaatattgttgactttgatcatccgaactgtgaggaaaccttaaaaattctggcagaaaaaaataagaagtagactttgtaatatgagggcaaaattgaaaaaaaaaatcataacttttataaacctagatgaaatgtgttctaaagccaggtgtgatggtgcatgcctatacacccagctactgaggaggctgaggcaggaggatcacttgagcccatgagttcagtactatagaatgctatgatcaattgcacctgtgaatagccactgcactccagcctgggcaacatagtaagaccctgcctctacaaaaaaaaaaaaaaaaaaaaaaagtagaagaaaaaaactgttaaaattgaagtcccttggtcgggcgcagtggctcattcctgtaatcccagcactctgggaagccgaggtgggttgatcacctg

SEQ ID NO: 138969 - DNA, 1055 bp, Homo sapiens
attcctaccagtggtgtataagcatgtaagctgtatcttgacacagatatgaaatgggtgattttgggccaagaaaaatattattattaaatatttacatctaaaaagaaaaattgcaaggaaaaaatattagatacataaacatcccctgatcttaaggttttcaatattgtttttgaagttattcctttattaagatagtaggtgtttattgtttgaatttttttagaatatgtaaaaatggaagccacaattttggtcagtatctttctagatacattgccaagcgtagttttatatcatctgaccttagatgtaaacacaatcattttttggtatctaatctttaaaagagctgtagacaaggctcatatttttttcctctttcagcattgttgtccagacatgataactaaatttttgggagtaattgttaaatcagaacgtccatgtgatgaagacaagactgattcagagacaggaaagttgatcatgttagtcaatgagttttattatggaaggcatgaaggagtcactgagaaagagccaaagacttacacaacctttaaatgcttcagttgctcgaaagttcttaaaaataatattaggtatgtaaatatttatttttatttctgtttgaaagttgggatatgacagataagaatatagtatctttacattgctctgccatcctcggtaattaattctaatactttctactaagaacagtggcagattatcatgttgaaaagcttttgttccttcttgtattttaagagtttgactccaggatccacctagttgttttgttttcagatagcttaagaaaagacaaaatgtattttaatttaggggaaaactacttattttccctacatttattactgaactagacggtttcatgaaaaacttatattttctagctgactttgaatcttacttttcttcatgtcacaagaagaaccctatgcagcatgacctcctccatactaaccttatttaaagctcaaatttttccattttaaaataaattgcaggcgtttaccaaaaccaaa

SEQ ID NO: 138970 - DNA, 1054 bp, Homo sapiens
tactgggaacattgttctttgtcattgggtatttcccaaaaacatgatgttatgtgatagtatcatttaatttatttagtcatttctttattgttatacatacaggttttcaatttttgctattataaatcattcttcattaaacattttcatttctttagcatagattcttagaaattgagtaattggaataattggaccaaagaatatgaactttttttaaaaagcccttgatatagatactgctaaaatttccttgcagaaaagttgttccaaaatataacctctactttgcctgtaatattatttttaaattttaacattttatttcaaactaattttagatttacagaaaaattacaaaaataatgcagagttcccatatactcctcacccagtagatgctaattttggcagagactaataattacctttgtgttttataccatattagtaattgagttattaagattctttatagtattgacatacagctaaatttatctctataaaagtttatgaaacaaaataattataaatttttacaggattttacaaagaattcacaagttggatcggataattcttcaattttactgtttgactcgacccaggaatcactaccaccatcccaagacataccagcaatttttagagaaggtttggtttagcactctttcataaaaattataaaaagagacttgtcgaatatacatatggaattgaatttctgttttgaagcccataccttcatgttaagtttttcatatattataacatggaatagagctaatcattcctgaatgcctttcttgggtgatatagaaaattgtatttagtgatagaatgttttatttatttctattaagttggctagcacatattctttgcactctttttcacttggaaccagccatggactgaacaatcttaatataatttctgtgagtcaaggaagtcccctgatgccttaaatactctgcgaaaacaagtagtaattatttggaagacacttaatatgagaaaacgtgcatggttatagttgatttctcaa

SEQ ID NO: 138971 - DNA, 1032 bp, Homo sapiens
tcaagtcacgggaatcagaatctgtacacaaccctgtcaccattaaaggaaagaaatatacttcaattattggttatgcaaagatatgtttttggaggaatttttctattagtatatatttcattcacataacaaattttaaaataaatataattttatagatattttgaacagaggccactccagctcatcttcaaaaggaataaagagtgagccacacagtccaggtacagtattactgtagtatttcaattttaaagttaaatattttgatataattggttgtatagaaatatattcaatatgttgtataattttaaaatacaggtattcctgaaatattcaggactgcaagtcaacgctgcagagacccaccatcaaatccagtggctgcctcgcctagatttcatcttgtatctaaatcttcacaaagctctgttactgttgagaatgcgtctaaacctgtaagtgtttataaaattacacaattaattcagggacacattggctattataatactgagttaaaattgtgatctgtcagccgggcacagtggctcacgcctgtaatctttggtactttgggaggccaaggcaggcagatcgcttgagcccaggagttcgagaccagcctggccaacatggcaagaccacatctctacaaaaatacaaaaaattagctgggcatagtggtgcaccacctgtagtcccagctactcgggaggctgagatgggaggattgcttgagccctggaggtcaaggctgcagtgagccaagatcataccactgcattccagcctgggtgagagggtgagatcctgattcaagaaaaaaacaaaagccaacacaaacaaacccaaaaaattgtgaactgtcatagctagttaccatttcagtagaaaaataatccccatctttatgatataactcaaccaaaacccaaaataataactgcaggaattgtccaacatattaataaatcagctaatatgcttaaatacagtattgaaaactatactatctaaatatga

SEQ ID NO: 138972 - DNA, 1126 bp, Homo sapiens
gtccactgtagaccatgcctgtagtcccagctattcaggaggctgaggcacgagaatcaagtcagtaggctgggcatggtggctcatgcctgtaatcccagcactttgggaggctgaagcaggcggatcacttgaggtcaggagttcgagaccagcctggtcaacatggtgaaacccatccctacgaaaaatacaaaaattaactgggcgtagcagtgggcgcctgtagtcccagctacttgggaggctgaggcaggagaatcgtttgaacccaggaggcggaggttgcagtgagccgagatcacgcctgggcaacaaaagcaaaactctgtcacaaaaacaaacaaatatcaagtcagtaattgctattaggattattacagtgcatcttaaatatcatactatgtattgcacagaaaatatttttctctttgaaaataaagttagcttctcttctcttgaaaattagacatttcaaaaatggcagaactctttatggaatgtgaagaagaagagctagagccatggcagaagaaagtagaagaaactcaggatgaggatgacgatgaactgatctttgttggagagatatcaagttcaaaaccagccatttcaagtaagcatttactttcagtgaagtaacgtttcataagatggttgtttctaatggaaaatatatgagatatctgtccttcatactgttgttcttctgtaaggagttagaggtaagagggagagtaaaggtcagtaagaacttgtgagaatcaaagcgggaatgtagttggggactggagtaaggaggtgaaaggttaaaatatcagatgtgagcaaaaggaaataactaagttaattgagggttaagatgacctgaacagcattgtaagccttctgagattggaaatcataatttttaatggaaccaagtagcctatttatttgttaatttttttttctcccttaaactcagatttacagaaaaggaagtgtttggaatacttttcttaaaatatcctgatatgctaaataagtttgtgttagtgtctgatgggggttctaatgtctaagcaactgcctcatcaaagtatcatcttgatatatgactataaaatgcataggtgctgcatga

SEQ ID NO: 138973 - DNA, 1080 bp, Homo sapiens
cctcccaaagtgctgggattacaggcgtgagccactgtgcctggccaaaacaaatatttattaaagtaatacatattcctagtttaaaaaaaaatacagtaaacatgtcagtaatagatatgaaatgtttccttctcatccccagcgataactactgttgtaggtttagtatacataatcacaaacttttttctgtgcatagacaaaaaataatttctaaataagatcatactatatatgttattatgtgccttttaaaattttttgctcggtagcatatcttgaaattaacaatgacagtactcagtttaaaagaatggggaagacctatttatttgttcccataatatcacagtggtgtcaacatgaatgtaaattactttttcaatcatcagtatatatgagtctcccttgtttctttaaatctggcattgcctggctttacctagtttcttaccccatagataatcatgtgttaagtacctactacatatccaatacactactgtgtgtaggaggaaatacaaagaaagaaaatatgtttttcactctcaaggagcttactttggagttgaacatgtataattaaggcacactaagaaataggcagtttgagatcatatatattaaatcttgaattgcatagcatagactgtcagtgcagtaagaggttaaagaaaaacaaatctaatggtttgctgaggaagttataattgaactaagagttggaaaggggcaaagaatcaatttggggggatatctgtttgaagttagatacttattaatatggcattttcctgaatctctgttaccacttctattaggtagatattgtgctcatgttagaggtgagaaaatagattcaagtaatttctccagagtcacataattaaaaatggtgcagtgaggatttgaactattcaatttgatgtcaagtgcatgctctttccactatactcgaatgatgtggacagtataaggtaaggagaaagggtattccaggtggaagaagcagtacgaatgaggacttcaaaggacacaatgagtgcggtattttcaagtattcagaatatacaaata

SEQ ID NO: 138974 - DNA, 1162 bp, Homo sapiens
gttttactacgcaatttatccaattacttttctgttacttttcaaaaaactaaaaatatctaaatgtatgtgttttcttatagtaataatatttctgaaatgtgaagaataggaatcagttaaagattaatgtcacttagcatttcagaattcagatttactaaaacatatattacaggataattactcatttttgcataaagatcccttttgaagtttatttgtaatctgataactccgattttttcaagtagtaaatgtttaatacatttaactatatgttaaatgtattcatttggaaatgaaccaattatggaaaatgaattacctgtgtgtattaaacatatcaaactcaaaaggtgggcttttgtaggagaaaaagactaaatttatgtgcatttaatttaacaaaatccacactagtagtagacatctttattttagagggtggaaaactgagacctagcttactgtcttgtctggagtcatatggtgagtgtgctggagatcaaaattagacccaaagattttggatctcaggtttcatgtttcaatacttggtgttacttaaagtgactcataacattgattgatgtcatgtgttcgtacttaggtgaccttgcaacttcatggatgacgacaaaccttttcaaccaaaaagtaagtatttctgctgtagttgatactaataggcatggtttttgtactgtaaacctttcaaaagaaaagattagagacagaagtgggcacattttcttaaaaacaaatattatttatttatttatttttatttttttgagacagagtctcactgtgtcgcccaggctggagtgcagtggcatgatctcagctcactgcaagctccacctcctgggttcacgccattctcctgcctcagcctcctgagtagctgggattacaggcgcccaccaccacacccagctaattttttgtattttcagtagagacggggttttactgtgttagccaggatggtctcaatctcctgacttcgtgatccacccgcctcagcctcccaaagtgctgggattacaggcgtgagccaccgcacctggcctgtttatttttaagacagattctcactctgtcacctaagctggagtgcagtggcgtgatctcggctcacagcaagctccgctgc

SEQ ID NO: 138975 - DNA, 2868 bp, Homo sapiens
ctgcaacagcccaggcttgtgcctttaccccatttcacagagaagaaaaagcgaaaaactagagaaaaaccacctctccaagaggtaaccgcacgcagcgcggaaggctgctagtgcgcaggcgccacgccccggtacgccccggctcttccggcgcgaggtcaccgaatcgactggccactggcgccggggccgcgcatgcgctgcgctgcctttcccgggcgctgattcctgagtgctgagcgcgaacccgaggagatgaagtaaggcgtcagcttccttttgaggaaggagcagcgggccactgggggtggtccaccgggactggtgtggtagagcgtctgcggggccgaggggcgggagcggcgcggggactggaacagctcgtcccctagttttgctcttcctcagctccggccggttcgcacttacttgtctgcttttctgcctaccctccccaccccccccgccaccgtgaagccctttaactaaggtgaagctgatcaacgagctgaatgaacgagaggtccagcttggggtggccgataaggtgtcctggcactccgagtacaaggacagcgcctggatcttcctgggtgaggtccacatctttcttcctcagtgctctccagattctcctgctcggtttccgactatttcggcattttcacccttcactcctgcttacattcatcgcccaccttcatatccatctgctgtctgcccgggaatccgtgttacatctcttttctgccccatttttagttttccttccctgccaaatcagtgctcatgagagttactgtttgccatttgctgtgctaaggttcagggactgttgttatttctctctcaccctctgacccattatactgctgaggaaattggggtgcagagaagttaagggacttccttaaggtcacatagctagtaagcgcaacaggcagaactatagcattctagaactcttggtcttagccacagctccatattgctaccaccaccctcccccattccccttcccttccagaattcactttgctcctctagctcctgctttctagtccatggccacgttaccattactgtattcactttatatcacaatcagtaattgtacaagtttgatgcttcaaagaggttattgtaccaaacattgtgctaagcactttatatacatcgttttatttaactcttataataatcttgcgagttacgtgctaatatccccatcttacaaatgaggaaataaatatttggaggggaaattattccctaggaaatgcttaacagtgtctttataacctttgtctatgtgtaggtggggttaatcatgacatatgtagactgattttgtatcatagctgtaaatttgtgggtaatgagcagatgaattcaacatgtttgtggaagcagaggtttgtgatggaaactatctgctttgtccataggattttgggtggcaggaggactgagtgatcagattagtttcgttagtggtgaccccgacttccactcaaaattaattactcctttttctgtactactggcaccttacatgtacttctgtcattgagtcagacttaatttctttctttctttcttttttttgagctggagtttcactcttgtcgcccaggctggagtgcaatggcacgatctcggcgcactacaacctctgcctcctgggttcaagcgagtctcctgcttcagcctcctgagtagctgggattacaggtgcccgccacctcacctggctgatttttttttgtatttttagtagagccggggtttcgccatgttggacaggctggtctcgaacacctgacctcaggtgatccaccctcctcagcctcccaaagtgttgggattacaggcgtgagccacggtgcccagcccagacttgatttctttaagggcagggcctgttgcttactgtttccacccctagtgcctggcctagtgcgtggtatgtagtaaacacttggtaaatgttggtggaactgaaatgtggttttctcttctaggagggcttccttatgaactgactgaaggggacatcatctgtgtgttctcacagtaagtgtcctttcatttcctgcctcctgagtcgacagagtactttgtttctgtaatacattttgtggcatcacaaaaaccacttattttcactctaggctgaatggcatccctgcatggggagggctggagcttctgttctagatcagtcccaggacatggttctagaatgttctgtgggagatccaagaggtttgttaatttgggagggcatcttggggatcctagtctatttctgttgtttttcactgaggcttgttcagcctgggcctagactggaacagactggactccttgggctcttgcaaactaggggtaacccatggtcacagggcccttctggcccttacctgtgtggcgtcatacgattggggcaaagcacagaggaaattggggtaaaaaacagaaggtcgtagtttgctttctttgtttctcgatgagtgtaaggttagtgagcaaaggcaatctctgcctggaggctgagaatcacagcccgaagggaacaagaatgaataggagacctgtatattcttcattctgctgaggtgttagcagcagcatttcatgggagagggtgttggcagctcatactggtagtagcagctggtaggagaggggctgggcagctggcctgcaaccccagagctaaacagcacagttagtccacagggctagaggaccttggcacaggtgcagaggaccactacgtttgggttttgtagtccttggaagcatagtactgtttcagagaagttggacagcatgtacaggtagcggaccatggcaaaa

SEQ ID NO: 138976 - DNA, 1248 bp, Homo sapiens
attaattaatctgattttagtttatttctgtccactttgtgcgtgataaacttcaaagtgatgtgttaaattctcccataactttctctattagtttctttttgcatttcaaatagcttttttaattaaaatttttgatttcttaattggctcataacgttttcctggcttatacctttgttgtgtatttaggcctttttcagtgtaaaataatcttcttagtctcatgtgatatttttattttggccttgaattagtctttgctctggatattgccacccattttttaattgggggttcctgttcttgtctgactttttctttgcaacctttctatgtcatcttgttctagatgcatctcttgtatacactatattatttgaattttgttttattaccttatctgcatgtttttgccttttaagtcaacagtgtcttactcttttataaaataaatagatatggggagattgttaacattaatctcgtgcgggacaagaaaactgggaaatccaaaggattctgtttcctctgctatgaagaccagaggagcacaattctggccgtcgacaattttaatgggatcaaggtgagtgtgcttattaagcaggttggttggacttttttcccatgtataggggtttcgttttctacctggttcccgcagacacaagggcagcacttgtgagcttggtgtgttgcgggggctgcagagatgtggagacactggtcaagaagagattccaggaaataattctgttggctcatggtcctgcaggacttgcttcttttccccatctgttaacaaaccatctccccaggagcataggcaccaggcctgcctctcatccaggcctctgtttttcacctttcttttattgtctactgtcatctctggtgtactggaggatgaagagactagcaaacattgctcttccatattgttgtgtgttgggggttttgggcttcatcatggcctcataatctagtacatagccatgtatgtctgtcatatatctccagtgacctagcatattgggccctagaaattctctagttaaaatctgatggcagattctacaaaagtaatttcatcctgaaattttctccccccagttccctctcatttccactgtcataagtgaggcactgagttcttagaaggagatagcgcaagtcaggcttattgatgctccatgtggttgctgcactcatttaggaaaagagctgcagttgaacagtgtcaca

SEQ ID NO: 138977 - DNA, 1049 bp, Homo sapiens
ggattacaggcgtgagccaccgcacccggctgtgaatgtttttgaactgtagcacctgtggttgatgtaacgtattcagaaaagaaaggtgctttttttttttttaagggagttcttttatttttttcccttttcttatttactgcttctttcttttatcctccagacaaaaaggaaaaaaagaaaaaaaagaaagaaaaagagaaagccgaccgggaggtacaggcagagcaaccatcctcttcgtcacccagacgcaagacagtaaaggaaaaggatgacactggccctaagaagcacagcagcaagaactcagagagagctcagaagtcagagcccagggaggggcagaagctccccaaatccaggacggcctactctggtggagcagaggacctagagagggagctgaagaaggagaaacccaagcacgagcacaagtcctcaagcaggagggaggcaagagaagaaaagaccaggattagggacagagggcggagctcagatgcacattctagctggtataatgggcgttctgaagggcgtagttatagaagtagaagtaggagccgagataaatcccataggcataaaagggcccgacgctcccgggagcgggagtcttcgaatcccagtgaccgttggcgtcactgaagacttcagctgcacagtagatttggaaataattatgttttttaaatgcagtcaaattcagttgggtggttactatttttgtatctaaaacttctggggctggattcttttaatcccttgactatttagagtcattgggagggctgcagtttcaacagctagatatcctggatattgtttgcaccatccattgtccctgtaccagagtatgtatcctgaactttggttcataaatatggctcttgaacccatagaccccagttgaagatggaattttcaggaaagggaaaatactagataattctagaattctagtcttcgtgttagatgtttatagcccagcatcttgggacctttccagttactaggtttggacagcttgatgtgaacgaatg

SEQ ID NO: 138978 - DNA, 1050 bp, Homo sapiens
aagtagagtgagtgagggggagagtaatagaagaatggactggattaggaacagaggaccagcttttatagggacttacaggtctttgtaaggcttttactcggaatgaaatgtggagccattgcagggttttgaacagatgagagacatgagctgacttagaggtttaacaggatcattccagctgctgtgttgaaactagacagtgggtggtcaagggtagaaacaaggaaacaagttgggaggtatattattttcccttaggaaaccctaacaaagtaccacaaactaggtggcttaaaataacagaagctgattgtctcaaaaatctggaagctagaaatctgaaaccaaggtgtcattggggccatggtttctctgcgactgcgtggaatccctctttgcctcttcctagcttctgtcagtggccattgatccttgccattccttggctttcggctgcagcactccaatctctgcttctgtcattgtatggctttttccatgtgtgtctctgccttcacatggccatctcccttctgtgtctccctcctcttcttataaggacaccagtcatattggattaagggcccaccctactccagtatggcctcatcttaacttatctaattacatctgcaatgacactatttccaaataagattacattctaaggtactggaggttagcatcacgacatatatttttggcggggacagactgtaacccatagcaggaagctatttcagtaatctgggcaagagataaggggagcttgaaccaggatggcagcaatagtggtagtgagaagtgatctggtaatgaatatatgtggaaggtagacccaaaagcctttgctgatgaaatgggagttggcccaagagaaagagaagcaaagatgactccaaggtgtttcagcttgaggaactgaaaggatgaagttagcaacaagtgtgatggtaaatgcagaaagacagcagatttaggagaaaatcatggtttggttttggacaaattaaatttgagatgcctgttagtcattcaagaggc

SEQ ID NO: 138979 - DNA, 1108 bp, Homo sapiens
actattaacatattgatgcatatttgatgtgaatattttcaaatctttttctatgtatttacatagaaacacatgcatgaacacacacacatacacacacacacacacacacacaagcaaacagggctgtttacattttttgttttaaggcagcagtagtcagaaatttaaagttcagaagtcgagggcacattcctgtgtttttcattttcgacaagtagaacaatgcagccatatgccggtccctctctggagttagtacccaatgcttggaatgtgagcagatgctgaaggctattaatgaagtccttgaagggaggcccattcatgtatgttgtagacacaaggccaaagttgaatgtggtggccaactgagcagctggtaagggactaggaaagcgaggaatgcaccaatgctggttgcgagttgatggaccatgggaaccacatcatctggaggagtgtcctgccattgctgtcatttaggaaatggaagcaacacttggagtcctgaaggcttttaacctcagttgttacattagtgtgttgcaaatgtgatagagaaaaaaaatctgggaaaaatgatctgatatggtctaaatgaaactagtttttatcatgcctaaaattggaaaactccaagactttctttttttctttttgatttcttggatacaaagaacaagacacagtaatgtgtgtttgattaatgccaactccctgaactccttaatgtcaactagctactcttcattaccaaacaccacatgtgctcttctttcagtttaggcataccagcgcagctgcagaagacacagtggtgatctctatcacaccaacaatcagatatttgtcataatagcctcctaatcatatcgcatatgaagcctcaatgaagtctttataaccagacatgaaataattaaccttttctaatttaaaagacctaatagggaatggtctctgtgacaggtgtaaaattccattccttctagaaaattactcacctagcagatgctccttctgactgaaagagaaatttcattgcaaaaagaatgttcaccttttattatgaatattgcacaatgcattaagacaatggctttcc

SEQ ID NO: 138980 - DNA, 1363 bp, Homo sapiens
gttttttgtttttgtttttgttttcacatcagaggtcaacaaacttgtggctttcaggccacgtcctgccttcaggagttttgtttggcttggatagtggagtttattatgtgaaggatataaggactaagctcatgtttccttctggtaacagtcatttagagctaagtagcagtcgcctccttttgactgcacttgcactccccaggtcatcttagccctgcctctcatttcaacttatttgcctcacaagtttggatccttcgagtactttggtttcttgctccttgtttacaggtacatcttaaacctgctgttttgggatcactgactactgtgatctgcatgaaagtggggaacatgatttgtttcctgttgtatttatcctggttctcagaatcacctgctacgcagtagacagtgtttgtttgatgaatgaatgttctctctatctggaacactgtgttagtttggattattgattctaatactccactcatccctgtgtctttccctttgccatgagactctgcagttttttgttttgttttgtttttggagacagagtctcactctgtcccccaggctggagtgcagtggtgcaatcttggctcactacaacctccacctactgggttcaagcaactctcatgcctcagcctcctgagttgcttgctcccgagaagcaagaaatgaaggcacacaccacctcacccggctagttttttgtattgtttaagtagagatgaggttacaacatgtgggccaggctggtctcaaactcctggcctcaagtgatctgcttgcctcagcctcccaaagtgctaggattacaggcatgagccaccgcacctggccagactctgcagtttttttctaccctttgacttcagacttcaccatttgacttgctttggccaataggacattcatagatatgacgtaagcaatgacttatgtgatcaggctagtgcttctgccattgcatgaaaagaacctactctgggtagcccatgggtccaaggaggatgagagaaatgtggaaaagacctgtctccatagccaccatttggagccaaacccagatgaggtcagctgatctctgggtgacactcagacatatgagaagtaagtgtttgttgttttaagccacaaattataggatggtttgttaagcagcaataactaactgacacatatgcccaatcttcacttcccaagctttcaaaatacggcccatcctcagttcatttcaataactgccgcctaatattcagttatgtcattgtcctccaaatttttatagcacattattattattgttatttttaattttactttaagttctgggatacatgtttag

SEQ ID NO: 138981 - DNA, 1049 bp, Homo sapiens
catgacaaccgtgttattattagctccattttacttatgaggaaactgaggctcaatactgaggttgtgactagcccaaggtcacagagctggtaataggtgaagctgtcaatgttcatggtatttaccatgagactacactgctccccacctctccccaaatttctccctccattcagaatgccttcgcctactcttattcggcacagtccatatactttctccaggtattggtaaccccagaaaaagcaatgaaagcatttacaaaatactatgtgccaagcactgtatcaaatgtttttcatgcagtatctgatttaatcttaaccaaaaactccagtatcctcttgcatagggcataatgaagcaatatggttagcagttaatagcatcgttttaggaatcaaactaccattttacagataaggaaagcagagcctagagaggctaaataatcacccaaggccaaacagctagcaagtggcaaagctgggatatgaacttaaaattttctgactcaagagactgtgctgttaaacacagaaaacatcttttaaaaacactaaatgtgatgttaagacaatcagtcatcaaagtttatactattttagtgaggtggagagcaagggtaaacacctaacttaattttcttttttctgtgacatgttgcctttcctgtgtccctctctaggtgacggagcctcacatgcagtaatttgtgctaacatcagcataatgagacagagcctaggcactgtgcatacataagccaaacaatacacaaaacttccaattgactaaaccagtcatgccggatttatgaagagaaaagaaaagggcggacgacgtgaccaaaatacactctcactgaaaagcactttttgtccccccacccccgccccgcatcccctgctttattgccttgtaaaacaagaattacagcataaagcacgtggcttatatcacaagcaggtcacatgtggtgctggtgacctgcagctcttatctacccctagcagattcacttgcagccttcttctgtctctgca

SEQ ID NO: 138982 - DNA, 1070 bp, Homo sapiens
tatttcttttttgttattaaatcagaatttcaatgtgtcctacttgctactgctgaatggtgcatttgccatacagatgttgatgcataatcaatgaacttttttaaaatgccagtgttccccatagcagaatcatcattcattgagtagggagggaggcagagctgagccaagagaaactgattctttcttgaagaatcatgctgattctctggggtccactgtacactggtcttcagagtttgagaaaacttgtgtcaggggtcccctatataaaagatcaacagaacatggaccataactaaaagatgttttactggtctcatgttttgctagcctctgtgtgtttcgtcacatgatcagcttgtaaagtccttaaaatgaactaataaaacatttaagtgtaggtagttatgtagagcccccaaaaggagggaagctgaggaggttatggccccttccataaccacaattatgggagaggagaggagatagcaactatggagaggagatgagacaaagctgaggttttgtagcctacagcaaagaaaggagcatggagaatggcctggaattgagaagggacccttatagtctttcattcagcctggagataaacatcatacatgaaattgtccaagagagaaggaacccaccagaattctgtgtggattttcttctcagatcccaaatactcccaaaggctgcaaatagaaacaaaggtgatttgatagatgagacagcttaaaaattttctgactacaaaacacccattgctggatagaatatttcattttcaaatgcatagttgagtatacaattaagaaagagaaattcccaaaagtcagagtccccccaaaagactgagagctgagtggaaagcacatgggttaaatgtgaggcttttctggcatgggagaatgttagtttcagtaatccaagggcctgagttttatagaagtttatgtaagtataggagattaatccattgacttacatgagatgatgtagatgctggcatggatgcagtgaacagagaacacttctacactgctggtgggaatgtaagc

SEQ ID NO: 138983 - DNA, 1062 bp, Homo sapiens
taattttgcaaagccagttttatgatgatcaaatcagggtaattttcacatctgtcacctcaaacatttatcttttctttgctgtgaacattgaaaatccattgtttttggcaaggccttaggcatgatcttcccatgttctcttttaaataaagtccatcatttcaggcagagctgtggagctctccatccttatggcctgactctcctcctgggcagtacttctgcaccactgtattggagctgaggtcaggggcagtggattgcttcttctggagtggcactcctgctttaccagtgggcactggggatggtggtagaccctggttttctcagcttgcctatcccatattagaacctctatcctctgaatgagctggggtggagccaattgggtaccactcctctaggcctatcatccctcagggagagcccttgcactaccagtgggagctgaatggggaaagggaagttcctgtcctctcagacttgcttaccagggatagaacttttgtaatatagggctggggaagatgagggacaccagcagcctgctcctctcaggttaaaactgtagccctggactagttgtggggaaggggaacacctgtcttcacatctacatgtgccagagttgagatttcatcgcacagatcttgttgggtggagcgtgggagcaggtagtagctcaaataccacaaactctcactgtactggttaagatttagtagattttcttggataaatgtttcttcatttgctgtatgttcttggggcaatttccagaaattctacatggtttataaaaataattttcagcacttaaattgttgttttactgcagaaacacttcgttgaactcctcacaccaccattccagaagtcctgcctgtccatgggccatttcttatatataaggaagaatgattcagtggatacaaccaagaactcagagggtggagccaagagctaagaagaatcattcccagagatcaggactgggccgtgatgaaagaactagtgatggatttcagaattgctatggaatgctatgtgtttcct

SEQ ID NO: 138984 - DNA, 1048 bp, Homo sapiens
aagcatagaaagtgatttatatttttaatggttttcaagtggaagttcctttgaatttgtcagttcattcctggaaaatcttttgagttaaaataaggatcctaggacagcacctcgaactacaggccctaaagagaaattgcctcaaaccacaagtgctgtaacttcctcccctttctgtcaattggttgtctttaaatattgcaaaagtcctgatgctaaacagtatttggagtgttttcagtgtctgtactactgttgtagaccttggtatttttttaaacactgttaactgaaatgttttgatgatttgtatgtgatttgtgtttctaaacttctctttacattaatgttgttactggtgaaaggcatgagagcagcactaagtcctctgtgtaactgccattgtctttccaatccccagtagaccagtaaataaataacacatcagtgtcttctagaaggtgcctgaccaggttcaccttttaaacgacaaagcatggtttgtggctttttgcaaaattactatgaaccaaaagttgacaaatgttccaaagttattttctctaacatatcacattaaagatctgtttcagaattgtaaaaagtacatctagatgtgtttacagaaagcaagtatccagtatgactggcatgtgttcatgctattcagaatcacttgtaaatagtctgcttttaaaggagggcatgttcagttttctgtgaattaaaatatgctcatgtgtgggcacacacgcacaaacacacacacgcacgcacacagtggcagaagggatttatattaatattctttcccctctggccttcttacagtctgttggtccctttgcttctgttgtcagtgtgttgaattgcaaaccgagtactgctgtaaatactatgtttacttcatgctgaatgtttgcaaagacttgatataagtattaatagtaatgaatcaatgaataaataatgagctagggtttgtgaggctttctacaaataggtcagctccacctggagtgcgaattgccagagacaccttggt

SEQ ID NO: 138985 - DNA, 1037 bp, Homo sapiens
tcattgacattaacagatgttacaaagaaaatcggaattgagagaaacaatgctgggcaagagctattttagtagagtgatagaggtaggggccagaatacatgacattagtaaaataaagtaaacaaagaccatagatcaagaagttgggtactaagcaaaaggaaatatggatattataaatggcaactagaatcgataaagttaagggtttttgttgttgttgttgttgttcaataaaaaggaaggaggcaatggagagtatgagattgaagatgctagaaaataaaagaatactatggaagtggaatctttgaaagaagaaagggaagggatccatattcaagtagcgtttactttagagaggagagagccctctttctctgagacaagagaggggaagctgaaagaatataggtagcccaggcttctccatatactaagagattgtttattcatcacaaaaatgatttggaaatgagaccacgaggagaagggaaccgatttggaataaatgctatgggcagtatggaaggaagaaatcagtgagaggtgagagacccatcagcaagggccaacatgagtgtgtattgatgtagctgcctagctctgcaacttcctataagagttctctgtggcccaggataagagagagtggagtcaagtgactgtgagttggggattggcatggtaagcctggccagaggttttcaggaagctgaagcaatacaaggcactgaggaggttgcactgggatctattcagccagaaagcagctaatgaactagcttagtgaacttggccactccgtgagattaaagatcccagcaaggaaagagagcagtcttggggtgatgagaggcagtgaggaaaatggtagatgaggattctgtgtttgagatgggaatttagagatgtaagaggggtaacaatgaggttccaggtgcatccatgctgacagaagcctggttggaatggtgacaataacctgtagaggcaagggaaagcaaggcattgtgaggtcaggaaacccactt

SEQ ID NO: 138986 - DNA, 1023 bp, Homo sapiens
ccactatgtatcatataatagacattaattaagaacctgagtttgtactttgcttcattatattaaatgatatctcagaatcaaatttctacataagtgtagaagctatctccctatcctctgctttccattcccttgtctgatctcttctccaccaattttcctcttaatgttgaaagtcttaggctgggcatggtggctcatgcctgtaatctcagtactttgggaggctgacacaggcagattgcttgagttcaggagttcgagaccagcttgggcaacatggtaaaaccccatctctaccaaaaatacaaaaattagccaggtgtggtggcccacacctgtgttcccagctacttgggaggctgaggtgggaagatagcttgagcccagtaggtcaaggctgtagtgagccatgatcacaccactgcactccagcctgggcaacagagcaagaccctgttaaaaaaaaaaaaaaagaaactctggctaagtagaattttgttacacatttattaagaaactgatttgtctggtaatcatgttcctatcataaaacatgaataagattaatttaaatccacatacatttttgtgaaactatagttagataattaatgtgtaacaatttatgatttgcttactttatgataaatcaaaaatgtcagctggcacagaagtggttcttttcatgtattttcctgtctccgatttcagttttattctatatgaaagtacattgttccccattatagagtagtgtgtgaatttctaagcttcagaaaaagttatcattagatcagactcagtcattataatgtgtttccagaaatcactaacagttcattgttgaaatgaaaaatatcacagatctactgtgggcaggagaatggtataaaaactttaggagggatatcttaccttttttgttgtagtctaccagtgatgtgacccagtcaatttcaggtagagatttacaaatgcaaattgctgaaaaatgtttccacatgccatcaccattct

SEQ ID NO: 138987 - DNA, 2192 bp, Homo sapiens
gtttaccttatttggtggcatatttttatttctataaatagtcttgagttttgttctaaatgcagttaagtaacttgggaaaattttggtccttttaggtcttgcttcttaagctttgttcagcaagaccagaggagtttagggctaatttttctccactattaaggcagaacccttctgatcacccagtaccagaagtgtgagtttttctgctctggctggtaggaaaaggagctattcccaaccctgtgggagcttttcagggattgttacctctaatgctcaggtagtttcccacacatatagacattagtactcagctaaataatagtggaggaccctctgcatatctctgaagctctttctctgtgcagctttcttctttctggtactctgccttatgaactctatttccatagtcttcctagactcccagttcagtctccttaacttgggaacaccatcgtgccctgtctgagttcccttccctgtgctgaggcccaaaaactctcttattaggaaactttcttattaggaaataaactggggcaatcatagggatcacttcatttggttcttgtctctcagtgatccctgtcttcattgtcttatgtacagttctttaaaaagcattatttcatatattttatccatatttttagttgtttaaggtaggaggacaaatctaacccgttactctatcttagccagaagcaaaagtctatgttgggtattattcttgagaggcaggttagaataaaggaaagcacagagtctaatgtcctggattcaagagccagctctactgtttgctaattgtctgacccagggcaagccacttaacctccctaacctcttttgatgctcagttttctgtttggtataatgttctacccttctaccctgcaagcttgtgctgataatgaaatgagataaattcctatggaagtatctagctgagctcttgaaactgaaaaagtacttagttttttccccactttttttaagatacatgacttgggtaagtatagctggcacagaaagaggaggtatggagttgaatcaggttttctgaatcccagtcctatactactatattataatcacactacatctttttttttaaggatcccaaattatatgtcacctgggtcacacatcactccccatctttttttttttttagaaaaaaaatggctcacagttgacaaatgcttctaggaagcaattttagggattaaaataccaagttaatgcatttaagttttaccaaaatctttgtgatagtataatggacactcttgaatttatttaaagacaagttcgtttgaggccaccttttccattcttcccagcccttggtgccatataacgatcatgcttgatactattacccacggagccaacctcagccagaggtaaggtattagatggaggaatggaactcttaagaacaagactaacccaacccatagaatgtgagctattatcagagataatctaaatcttttgatgatttacttgctaagcatggggagagaatttggagttgtgtggtcacttggaactgctgcagtgacatctgaaacactgaacttggaaaagtatgtatagtctttcatgtctctctctctctctgtctctgtctctctctccctctacttctctccttctctccctctctcctctccctttcaccctcctgtggacttaggttaccgcattcgcctgggctctagtactgacaagaaggacacaggcagactccacgttgatttcgcacaggctcgagatgacctgtatgagtgggagtgtaaacagcgtatgctagccagagaggagcgccatcgtagaagaatggaagaagaaagattgcgtccaccatctccacccccagtggtccactattcagatcatgaatgcagcattgttgctgaaaaattaaaaggtatcaaaggcactcaagcttcatgattaaaagaactcttttctttagagaagtgtcataaatataattgcattgttgacagttacactttgagtttcctactaatggattctaagcatttcttgtgttggagccttgcagatagagaggtgtacctagtaactcaagaaccaggaaatttatccctactacctgtgtctgctccttcattgtctcaagggatggcatttttctcttcagacat

SEQ ID NO: 138988 - DNA, 1027 bp, Homo sapiens
aaagcccatgacttcaaatggttttcttggttgacattggaaatccacattcactttggtgcttaatggttaaagataaacaaaagaaataatcaacgtgatagaagcctttgaaatgtcatgtacaacctgccctctaggaagcccttatgggcagtgtagcctatggaactcctggcatattgaacaaaaggaagagggggagtttatctactctggctttagccatatgcaatgaatacgtttgcttttaaatgaatttataaaatattaatgtaattatacgaaacagcagagtggtaagtacatcagtcaggagttatatttatcctgtatatttgttttttgtttgtctccatttattagtagacagtaaatggagacagacatttccttctcagccaaagtggcagaacttgtttaatgagctgatgtttctgtaatctgtggtaaggtagagttgtgagtgacagagctatacgaataacaaggaggcaggcagaacaatagaaggaagacaaacatttcagtagaagaggaaaaatagatgggattgttttgttggcacacaatctaatctgatcttttcctaacgaaaaataacagtttgtaaatgggtaagataatgttaataatttctccaaaatcttctgcatgagaaatcaaattttccgaagacataaatggcattcttaaccatagtgctcttattttacagcataggaagacagggtatcggaagccttaagttctctaagatcaaacgggaaacctagacaccacccccaacacttgcatagagcctgacatataggaagcctatcacagatgtttgtgaatgtgtgaatgaatgcctcaattagtgaatttatcagtgtgagttttcacattttaaatggaaggaaggaaacttacctatcagtactatctctcacgccagaggtcttcatatctgttctgtgctttcgtcctttgagctaaatgccattatttacccccacttttaccaaaaaggaaatagaggcat

SEQ ID NO: 138989 - DNA, 1032 bp, Homo sapiens
agagcactcaatcttaaatcagttgccctctagttcttagatgtatatagggacatgccaaccaagagtacttgcctgaaaagcactgtacccagggaagcaggccctgtcggtggagtttggttcaaaaatgacacgatcgtattcagataatggcagacacctccctcctggttccctttaacgacatctgtccttctgatttacctcagtttcctcctgttcatctcccttggtcacccctgttgtgagtgcatttactgctgatggaaatgtctaatatgcttggcagtgtaagtcttactggtaacattcatgcgggaatgtgccgacatcccatcttttcctctaaccagtatgccaaaccagacttgtcgctctatacttgggacttctgtagaggcttgtttggtctttattttgtgtgtgaatttgtctacacccaaccacaagtagatgctaagctctctgaggaaagagcttcagtcttctcagagtcctctgcttctcctgtgtccctctcagccattaacaaatagcacaacaggggctcagtcagtatctgttagttcatttgtaactagaaaatattacccctggtggattatactgtttctgaactgagatgtactctttttttcttctcagaagtaagcttttactctaagcttgtattggactctgccagaagtaaacatgtcttctgtgggtctgtgctgcaagctacaatcagattttctaaatgcagtggcttaaggattatatgcttttcactacagccgagagggtgagtaaaaaccctgacccattgcattccataggtgctgccatcatggaaagagcaggctgaaggcctttgcttccttaccttagctccctttataacccaaattctttgatgggccaggagggctgcctctgctgattttcacttaacctctccatgcctccctgttttcctcagaaaagcccatcaatatcgacctgctttccaaggatgtttgaggatgtaatactgataagaaaacactc

SEQ ID NO: 138990 - DNA, 1030 bp, Homo sapiens
tatattaggcgtcatccctgccatcaaagtttttattgatacatctcagcagggaaaatagcaagggtgcccggttagctattaatacaaggtaaaatgctaataggcatttagagagtcacattagtgctacgtatctcttagagaggtacagagtcagaatactttctatggtacaagagaacatccggagtggaaaatgttcagttcctgggaaacaaaatggggaggggtcccttagacaaaaccagattatccttgtgatgttaaattagtactgattctgcaatgaagagtaatatttaatgctacaaaccctgacttaaagaaaaacgtactgaaaacagaatgatgcagaacagatcattgctggattccttctgctcctttgatggaaataaattggataattttgattcctttatcatcctttatgaattatatttcctagtagaatgcaaatatcattggtaaagaaagaaaagcagagatgaatcatcataatgaatgttcaaataaagaacatcagattcagaaagctacattactatattgcctaaataaaaccaaccaggatttcccactgcaaacagtcttaggcttttgtgtataacatgcttgtttaagtgcagtgactggaacactgattccccctgggtagtgctgtagttggtagtactgtcgcaaaggctttctggaaacccaacaaagttcttctgttgaggttctcttagccacttcgagtaaaatgcatccctcctgattcattggtatccattagctttctttgtttctgaataacaatgtcctgccccagacttcctaccaccaactggaatgggaagggtaatgcagaaggatggcatgtcttgtaccatacccaacccactcaccctccatcctcaccttgggatctctggcacttgccaagtgacttcgctgtatgggaagctcatagggattgaagttgcacctgtgggtgtaaggaagggtctctctagttgtcagacagcagattcagcttactctt

SEQ ID NO: 138991 - DNA, 1128 bp, Homo sapiens
ttgagcaagtgaaaggccacacgtgttctaactcatttttgtatattaaaaagcaagacagagaagtcatcttttacctcctgaaaaagaaaatgctcttttctctttggaccttgtctctaggaaaagtccatcctccctacctacgaatgtaggtatccctagaagtatccctttgccctagtcatcaccttacagaatgttgagatgcaggaagaggaattaaccctatatgtctggaaaacatcaggagagagaaatcacacagtaatttgaacagaaaaattttaatataaatattaactataacaggggattggccagtaagaagtaaaaacaactacaaagaatataggactaacaaatataaggagcagcccctacacctagagctgaactagggcacccaggagagaaccttttccccagggctgagatccatatcttgcaggacaagggcacagtcatgactcattaaatagcagagaaattgctgtggtactacatcagcagaacttgctggaattctgccctgtggaacttctgggaaatccaccctctatagtgtcagggaaagctggtcacagagaggtatctcacaataggcaccccaccatgaaacatcctgagggatgggtactgggagaagctgctgggcactgctgattatactaccagagctgcatgcttgaaaaattgcacatgctgcaggaacctggtgcttggggagctgtgtgtgctgtgggaactgggccctggggaagctgaaagcctgaactacaggaacctgccaagtgagcacacctagcacaccagcacacaggacccacaaagaaaagccccttcctcctgaaatgtctccctaacgccctctactgacaaagcttaacattgtgccagctggcaaaggaaaaatatataaagggcccagaaccattttcacagagcaggcaacaagggtgaatttggagctaagaggtattagattgataactagcacacctacatagctcaggtaatagtcctcaggtaatagtaactctctaatagtgttattgcctagccctagctcgtattctgagtgatctctcttcctcttataatttggagatgaggggatagaaatca

SEQ ID NO: 138992 - DNA, 1683 bp, Homo sapiens
tggtaattacagcgatgtccctgggctcctattttgaaagcatgcgccacattcatgaccttccaggctcaggtaacagttgctctttcctgggattatgttgtttattgttattggcatctgatatttccttctacttctctcaagccagggttttccttccctgaagtttcttagactactcctccgtgtatctgaccctttgcttattagaaagcgattatacccagaacaaaatgctaatttcccatccatcagaaagtatatgagggcagggaagtgtgtccagcataccatacctttaagaaatgcttcttagagggagaaaatgaaaggagctcagagggtcaagtggatggagataaggatgagcagttttcagccttgggccacttttgccagcagtttgctaactgcccttgagctgattcccgtggttccttctccttagtcagaaggcatatatatattccccacagggcagtctcctcagactaaccatgacggtcctgcagcatcaaaccataacttacttgttcaacatcatctcctattccatcccacagctatggccatcatggttttctgaatcagaatttgaataaaaaattaaagcaagtggttggatcaaatttttttttagtttttccatatgaaaaaacttaacaaatgtataaaaatgaagtttcattcattggctcacctttattacatttcctatttaatgagtgctttcatgtgccagcactttgctcagtacttggtgggattttatcataggctcttcattgcaggcccattttacagaagaggaaactaagccccaagaggttaattaattaacccaagataatacagcaagtaagtggtaatcctgagacccaaacccaggtctgtctgactccaaaggccaagctcttaaccattgttatgtcttccttcaatggcattttattcataagtgaacagaatgttatgaaaggcagacagccctttgagcacttagagtgaatcatggctctacttgacattctcccactgctctctactcaaatcagtatcctcacagatatgcaacctcatgtatgcctgcccctttggtttagctcatgctgttctcttcccataccctttactcactctttagtctagaatcatcctcttcctcccctccgccagttaaattctatccatcctttaaatgcttaattccatttcttccatgaatgtttccctcactgacttctctctttcccatgccaccatagcacttattgttgtgactaccatatttaacccttcattatacactatttagggcatgtgaatttttttttttttttgagacagagtctcactcaggtgcccaggctagagtgcagtggcagaatatcttggctcacagcaacctccgcctcccaggttcaagtgattcttgtgcctcagcctcccgagtagctgggattacaggtgtgcgtcaccttgcccagctgttttttatatttttaatagagacagggttatgccatgttggccaggctggtttcaaactcctggcctcaggcgatccacccacctcggcctcccaaagctgggattacacgcgtgagccaccacgcccagccacttatgaatctttgtgaggtcaggaaccatgttttatattttaaatatgttctcata

SEQ ID NO: 138993 - DNA, 1094 bp, Homo sapiens
attcagaggttatagttcatcacaggctgcagagaacaaatgatagattccgaccaagggcctaaagttggagctagccaaccaaatattttctggcagtatttagtacttcagtgccatcttttgtctctccttatttaaattcttaagaatcagttgaatgcaggactttttctaaactttaatggtttatactagtagggaagggagggtgaacatgaagcttcatcaaaaagacgactatctatacagcagtagttcttagactggtcaggaaattcactgcattgctttacaaccttcattaagggcactcttccattgagagctctcccatggaaagaagttggtcttctttctctgggtcttcataaatagccattgcagggttctgcatgtagtgaataagcagtaggtggtatcacatgtactgtttggtttctcagctctcagcactttagaatctagattgtggaaagaagaggagcactttttactgtgcctttttattctccaatagctcttcaaacacattgttctgatcctaaagtcaagcctatagaacaaaccaggatcctccaaatgtgtccctatctgtgctaaagagaccaagctttctgttacaaagtaaatttttttttcaagacaagcatcatatgaatccggatattggacattgtagttgtttattaataataaccattatcatttgtgctatactttagcatattttcaaaatgttttccgttaacagaggaaagaaaagaggagggtactgatttagcacagtagacagtatgaagcagaaatacctgtgtttgaatcttggcactgctgtttaacttttctatcttaagactctgttttctcaactgtaaaatggaaataatatcttcataccaaacttataaggtcattgcaaagattaaatgtggtaatactcttcaatcttctagcacagccgtccgcaacctttttggcaccagggaccggtttcgtggaagacaatttttccacagactgagtcggggggtatggtctcgggatgaaactgttccacctcagatcatcaggcattatttagattctcataa

SEQ ID NO: 138994 - DNA, 1065 bp, Homo sapiens
gacaggacacttaagtacagctaaatccccattctgaaaagcagtggtaaaagaattgaaacataagaactgggaagggccatttttgaattgatgacctcttccccatcatacctctttcctccctggtcatcttaaagcacaaagattttaaccacaaaaggttattttctgctgcctgtcatgcctttttgcagagaatgtgaaggtgcaggaactaatcaggatctttcttggagctacattgtgtaaattctatgaatctgcccctcaagatcaatattccttagctacatgaccttattctttcaccagtacagcttggacaaaatgcattgtgcatgtctatgggagtgggagacatgaatttgtaagggaacgagcatgtgtatgaatgagcacaggtatgctaatgctggcaggattaggggagcagagacaagataggttttagtgataaatatatgttgccacattcccacagggaatttgacatcctcatcctaaggaaaatattgaagatgaagaaaatagaagagtgagtaattaagatttgagaattcttatgggacgtatgaaaattttatgctttagtcacaggaaatattctgaacaattatgtagcactgtgcttacaaaggtgaagattcatttaccacagtacagggtacattattgcctgaatgaatatgctttgtgcttccagttttcatctttttcagaggcaactattgccaattgcctagtttagctaataagttagagtttttgtactacaagctgttgtccaagacccaaagtcaatttaccaattagtattcttcctctttcccaatagcttcccacctgcagcttatccatccagaaaacgggcagagtatggcaagagattatatttattgaacacagtttagggcatgagatccattcagtctggagaaaatgttaatgaatcaagttacaaacccacaagtaccagaaacatattcttagttctccctcagaaactgcactggagaagcagcttcagtggagggcccctcgggtcagaagataaattagcca

SEQ ID NO: 138995 - DNA, 1044 bp, Homo sapiens
ctttcagttttctgtggccactcatggttagttttcctccaggacaagaatttgtagccctgtgcacctccagaaagaccaagcaatccccatatacaagtctactgttagactgaaagcttagttgggaataagaaaagaatcagataatgtggcaaggtggtggacagcaggctggggtggttggaaagaggggacacttagagatcattttgttcagtgattctcaaccaacatgcctaagggtgtatttatctgacactatagcagtgatccttgtgagagggtgatagcagctagaaggaggtattccttttggagcagctaacaaaaaacatttacagggagaagggcatttgtgtagttttagaaaactgctccctgcccccagctttaattgaattaagtttccaaacatacagcagttcagtatcagaactatgccttgattttgtgtcttcagactccctatcctgtcttctttttcattgcattctgctatgggaaaaagaaaagagaaaggaagtaacataacaagggagaaagaagagaaaagaaaataactgcctgttatgacctgcctgcctcctccactgtcacttagtctcttaaaagtgtcaaatagcctgaacccttgacttcaaatgccagccaccctgtctcccttgagcccagttacagcaacattcaactccttgctaaaacatgccctatgctttcaatccattccctctacctgaaatatcctcctcctcttaaccaggcaaaatccaatatgctcccccaaatgaaaatgttttaccactgtgtgggttactttatgcaaagatatctgtaagtagtaacttttggctaaataagtatgcagtgcacttccacagttttcatcttatttgaaggaaaaacattgtcaagaccaagctccaacatggcgacttctaccattaaggctacccagatcttctagtctgaattaaattctcctgtgttcaaattagcatttttctcttatagcacttactatttcttgtgtattataggaat

SEQ ID NO: 138996 - DNA, 1045 bp, Homo sapiens
ttcttattcccaactaagctttcagtctaacagtagacttgtatatggggattgcttggtctttctggaggtgcacagggctacaaattcttgtcctggaggaaaactaaccatgagtggccacagaaaactgaaagacttgagcacctgctccacaggcagggaaggggataaaattactgggctgccactaacttgcaaaaataactcgggggctatcctggatgcaaaagcagcctgatcctttcaaagaacaattgtgagaaatgatgtgtgttgtggggagggcagagaacagagtgacagaattctaaattatagagctatccttcaaggcctaattctttagaactttctcagatatagtttggatgggagtgacagggtagggtagagaggggaagaagatgatcggtctaagattcatagtcttttttttaagctgacttactcttaagaaagttttaaattgcacacaaaggaaaatgcaccctccgcatgacgctctatgaagcctaattattggagcaaatgtttactgaattaattttagaaatacaataccaatgctgcctgtttcataatctaggggaagtattttcttctcaagccatgttcagcctgcaacaggaagccaattatcaccccagaacatttctcagtgaaaaatatgtcattccttcttaggacaattaaggcttaagcaggcttaagcccccatctcacagtgttttcttatttttaccatctaaatacctatcaatccaaaccaagatcaattccatttacataacctaaagatgtcactaacatttggacaagggaaattttggaaaaggacaagatatcttttttgcttacttgaatgcccacattggcttttcctgaaatcagaggataataatggggctgctgagggaaaaatgcaggaaataggcagtggtactgattaaatgagagtaaattcagttttattactttcatgtaaactcagtaattctaactaagaactaacaaatgtagtccctttagaattcctaggaaa

SEQ ID NO: 138997 - DNA, 1330 bp, Homo sapiens
tcaattaaatcaaaatgaaaatggggccaggtgtctatgctatttcagagcaccccagaggattccaatatgcagccacacttgagaagcagtgcagctaattatactgtatcaaaggactattatacatgtacctaggccactgtgattcagaatgctggacatttgtagtattctgtgacacagtgtgtccagagtcctctattaggaactgaaatgacagaagtgacagtaacagagtagaccaaaagatggtaaagtggttgtgtaaatgttgacctctctaggtatctcaacacagaaagaagagaccacctaatttgcaattttctctttctctgctttctctgctctatttcctgatgtccattgattatctacagaaataaaaatccataatgatgaaattccctctttttgtgtgctaaggggacagtcttgatttttttccaatcttccatatcctccataatgtgagctattcaatttaagtcatgtagattgtagtatttcacattgagcaattgcttgtgtaatataattaattttaaaatattttgcttattctgcatttgaattttaagcaaaagcatctttagtgttcaagctgttttgtagaatatggtgaggtgatgagagtggtacacaaaaccattagagagatactcaactgcagaaacagagtgtactaattttgggagagggggcaggtttcagcaggtggcattccctatctccagccacattcttctgcatatttgattcaatagaaactataacagcagcagtagcttttattaaatattgattgtatgccaaccgctatgaccaagtgctttacatgtataaactcaagcaaacttcccaagaaatctgtaagatagacaccattccccacttctttacagattttttaaaaacctgaggcttggaaaacataggaaatttttccaggcgacaactaataaatagtataagcagatttgaaagagggaggcagagtaacagttgttaagagcacgtgttcagaatcctggccctgactttaggcaagttattgcagctcttgaagcctagtttctttacctacaaaatagaggtaataataccaagtgcacagggttgttttaggattcagtgagaaaacgaataaatagtgcttagtgcctggttttcttttattcagtgaatatttatttagtcttaataagtgtgaggcatagtggtaggctttaagttaccacaataagctgtgaatgagacagaatccaattctggccttgagatgctaacagtctagtaaagaagacagtcattaagcaaataacta

SEQ ID NO: 138998 - DNA, 1053 bp, Homo sapiens
ccagttccacactacacaatcttttttcctccctttcccaaccctcctacctcttccattttctacaaactgcctctttccttttgtactaaaactgatttcttaaaggtcacctgtgaccttcagattgtcaaagtcagtggccttttggcaggtcgcaaccaccttgaactctttgtttcatttgatgctattaacaatgcccccttctttgtattttctctacttttgctttccttggtaatacactttgcagattcttcctttactgtctccttcaagccttctttctcattttcttcatccctcgactgtaagtatactattacccacatttctagatgaagaaataaaggataaacttacccaaagttgaatgtctagcaagtggtttacccaggcctctaactccaaagtctatttctaactactatgctgaagttactgtgtctaaagttattaggaatctagaaccaccactaaaatgtatgtaaaacattggtgcagactagggaaagctgtgtttatgtggaaataaataggtaagaataagaggagcaggccttggatatgataatcttgaggatcccttcaaactcagatctcatggttcctcttttcagctttcttttttttctgctactccccaaaacaagtcttctatttcagccacaccgatccactacttttctctgaagacactgtgcttacctacctcaccaccgtgctcataccattcatttccctttcccagcatgctccccttcttctttcacttgtcaaagtcttatccaactgtcagtgcctagtacaagtcctaccctctataagaagccttctggatcatcttaattagaaatgttctcttgtacctctgaaatatatcggtcattaaattcatatcaatcacttgacactgattgtggaccaccttgaactattgcttatgagtttgtgtatatatatatatgccttagcttttcaactcagttataactcccctgttggaagggccccaactctcttagcagagatatggtgtcttacacaaaa

SEQ ID NO: 138999 - DNA, 1031 bp, Homo sapiens
agaacaaaaaaccaaacaccgcatattctcactcataggtgggaattgaacaatgagatcacatgaacacaggaaggggaacatcacactctggggactgtggtggggtggggggaggggggagggatagcattgggagatatacctaatgctagatgacacgttagtgggtgcagcgcaccagcatggcacatgtatacatatgtaactaacctgcacaatgtgcacatgtaccctaaaacttaaagtataataataataataataaaagaaaaaaaaaaagtttttctgtttcaccgtcattaatcagaacctcctaatccctgaacattccttttcatcagcattttaccattctgtagtatagtactcaaatgatggagatgcacttagaatctaattattttaagtaatgttgatataatcagcatcagaacttttaagctgtggcattaattcttgattatcagctgtcaggtctttcattacatgggttaaaagaatgagtcatctacccccatccaattaaggattaattcatttgggcgctcaaggtatggtgctaggcaccaagaatataattgtgggagggagggagagagggaagtttcctttttaggagagctttcaagtttatagggggaaagtttgttttaatttacttagaataatgtaattctcataaatatgtatgtgtttatctttgccacagccttaggtgtgttatcactctcttttacacattatgaaaccaagactaagagagaccacatgacttgccaaaaggtatcagctagtaaaggataaccaggatttgaatcccggtctgtcgggatctttccactatgccattctgtcttccatggaacttgttttgatcagtatatttcagaaagaaattccaagaaaagttttggactagtatattaatcatatttgactctgggactaatcaggtacgagaacaatcttcatttgtaaatggaataaacatctagtcttctttttaaatagtcttggtcatgatctca

SEQ ID NO: 139000 - DNA, 1036 bp, Homo sapiens
tttagggaaataaaaggaactcccaaaatagagtaggtggtagtttttaaaagcaagctgaatgcctgggagcccagcaaggaatgagtcccaggcgaagcagtgcccctggatttaggcctgtcaggaattctatagataaaatttctatagaaatagaagaataaactagataacctcaaaactttcttccaaatctaatatttttcagtttcatcatgtctagaaaaaatggtagaaattgcttccataagagatttaaagataaattctgtagtttgggtgaggattacaatatggtaattgccaatatttttatatttatgtcataattgaaatttcagcaataagaattcttggaattaaagtggtggttttcttttttagtatttaatcattttaatgggactagtttacttaaaatagcatttgacctgggtcacatatacatgacacaaaaaacaccctttaaatacctattgatttactgatttattggtttgtttggtcctgtcttatggaaggaatgaaacaaaacagtaaaagtagctaggaagcactggtgtcataggattttgctgtctctttcatccttcctcttgaactacaaatctttggagactgtattgggtattggatgatataaaatatgggtttgtgttcagcgagtcagcttactgagtgagatgtcccccctccatatgagatctttctctataaaaaaaattaggcctgaaatgttgtactgaattgtcatgattttcacatatctggatcatatatgaggtggatacacagaaagtacttgaaatctcagtcttaatttggtgccaaaaatctgtacatccatgtaattaataaaataactatatccctaaggttaccatatgggcctaaagaaagggcaagcataattataataaaatgtctataactgaacacctttaactcattagatttttttttcccctggattccttcaacttttagaaaaaggtacaaacaggaatgaaaaggttcaatgaggaaagcaggg

SEQ ID NO: 139001 - DNA, 1507 bp, Homo sapiens
tatgtattggtttgggtagaggtgaataaggaaagacaccatgaaggaaatagcatctgagataagccctaaaggaaggatgatattttgaacattgaaaattaagaagcaggtggaggagcagtgtgagccaaaggtgtggaggtaggaaagtactggatggattcagtgaatgctgtagttccattttgctggagtgccagcccttttgactcaaaatgtgattcccacaccagcaggattagcatcatctgggaacttataaaagcagaccacaactcagatttactaaattagaatctgcatttttacaagatcctcagggaacacatgtccacattaaaaagtttgagaagtattagggtagagcataagctggggcatagtgggagacaaggcctgaaatggatgcggcctttttatgagagactttagtgacttgaccaagtagtttggggagtcattaaaagttgctgaaggatcactgccaatgaaaattggtctatgacctgtatcccaccttgaaaatggtgacttaaagataaattaggctctgaaagtttgtctaccaccattcaagcaagccccttagtgcttccgaaaaggacttttccgttttctttctcacttcttcttcattacctttacttacccattatttgtaactcatacaattacccttgcttcagctaaaccagttagaatattgaactcatgaaattgacaaagtaggtttcatttgtttgacatcagttaagacctggcactgagaaatgttcaattgtcttggctgctaagccctgtggctgaagagtaatattgcggtccaactcttttggacattgtaaatattccctcagaagtagcaggtggaatggttgggtagtgagagctacaaatatggttttgaggcctagaatgaggaagcaggaggggtgaatgaaagtgaggagggccctccagagatggataaatccttcaacagcacctgccagaacattaagggcctggccattatcttaatcccttatttttccaaaagttttgaattgaaaacaaatttggagaccctcatctcccaacatggaatctcatatctgattttaaattgaagtcatttggaaaataagaattaggttatagaaacttgttttacagacaaattagctagactgttcttattgccaagtactgatattttttcaacattaatttatgtgttgagattgttgccttaatttgaatttatcagatttctcaagattttagccattttcttttaaagctaactaatccagggtggcattgtgtttcttttcgctagggttatacagtctctgagccacagctgcagataaaaagtggcattcactcacagggtcacattttggtattacaacctggggcaatcattaaaagtgttagattgcatcatgaaggttggtcctaatttgacctgatagtggacagctatgtaaagtgaattgtgacagtaactgttaaagca

SEQ ID NO: 139002 - DNA, 1110 bp, Homo sapiens
agacatttccattgttaggggaaaatgtgattctttcatgttggacagttcaaggtagtgatgaatatggtctcctaaacagaatccaagcaaagagcaatcactgactactcccgcattatttattcatgatttactttaatggctttgtgttattaagaaaaagtaggttagaagaggaatgcaaagctaacatcttccaagctgtaaatagactgtagcctggaggccgaaggagccacactactcaaatgttcttattccatttttgagacaaatttatataaaccccccattgggttagaagggcattgacatttgtttagtgtccaacatgtgctacaccttaaacatacaatctcttatttaattttcctcactttgctgtaaggggggcattatcatccccattttacaatgcagaaacagtctgagagagatcaagtgacctgttttatacaccttgtaagtggcacacttagtaagtggcacacctagtaagttgcagatgtggctttgaatgcagatctgactctagagcagcactgtccagcagaagtttctgggatgattgaaatgttatataaatatgctgtccaaaacagcagccactagctacatgtaactattgagcacttgaaatgtgattagtgcaactgagcaactgaacttttcactttttttctttctttctggttttgttttttgttttttgtttttttagatggagccttgctctgtcagcccaggctagagtgcagtggtgtgatctcagcccactgcaacctccgccacccgggttcaagtgattctcctgcctcagcctcctgagtagctgggattacaggcgcgtgccaccatgcccagctgatttttgtatttttagtagagacggggtttcaccatgttggtcaggctggtctcgaactcccgacctcgtgatccacccacctcggcctcccaaagtgctgggattacaggcgtgagccactgtgcccggcctgaacttttcattttattccattttaattaatttaaagagctacatatggctagtggctactgtattgcatagcacatctccagagattgccttttcttttttaaaaa

SEQ ID NO: 139003 - DNA, 1037 bp, Homo sapiens
agccaggagggaggataaaaattttgaatatgtaaatgaagattgaccatatttatgtggttctatctttagggaatgctaaaccacaaactcatcattggttaattagaagataattaaaattgtagcatagtgattggataaatagttaatgaaggctgaataaacaaagaaaggaaatctggtgaaattggtgtgtacattttgggcaaagcaaagatacaaatgttattcatgcggtgcatcagtcttaaaggataccagtatccttctagcattaactgataaaattaactctccaaagaccaaaagaccagctctcactttctccttcaaaacatcttacactgaaatgcagatttatttgacagcaacttcaattttcattcactcacagcatgtgaaattattttgctgaaccttgtttacaacttatttactggcatcttaataatctattagcagaaattggtgttctctgtgtgtagtaactgttcctacttaaagagctggctcagcctaggctcctgaccagatctggctgacaagctagttttcaaaaccagtgaagtggtttctgcagggagaactgtgcttgcttttgataattgcctcagttttatgaaatcaatcagcctgaagggaagacctcattacagatctgacaagatagactccaatttcaatactagaacaactctctgtcctcaggctctgaaatctgcaattatttattttatttagacagagacaaccataatagagtacctctgggcacattctcagggaagtactcaacagataacctaatggtcagtgtgctaggaacctgcccttttcctgtcactcaggtggaaaattggtcaacaggaattacagcatggcctagagccagctcaaagcagacactgatgaatcaccatctttccaatcccctaccccaaaagatgtggagagaaagggtagctgctgtaactgttcccagggctaaactacaacaaaataaggctttctcttctcagttcctctgaagactg

SEQ ID NO: 139004 - DNA, 1050 bp, Homo sapiens
tactatgttattctgcctcttagacaattatactttttttctgaatgaattaatatcttttgacaagctttgttaagaatacctagtaaaggtcaagtgtaagccatttactgctgtttcctggcagcctttatgccatggtaaatagagattggaagcagttttatttttgagcatggatttatggatatgcttctattggactgtgctttttctcatactgaaacccacaaatgttgcaggattttcaggactgtggcttaagaattttttcatggagtcatctcagactcctctcttctcctcaactcccagatccaattatacatgaaatccagatgattatatttcctgaatatctctgaaatccattcattttttttcatcccactgccactgtctgagttcatgcgactgtcatctctccattgtatcattatggttttcttctaactggtctctctgcctctggtgtcttctcaccttcagtgcatccttcatcatgccataggagtggtctttctaaggcacaaatcagatggtgacagccccccacccagaacacacacatacacacacacacacatattagaatgaactctaagatcctacaataagtcgtctgataaggctctgtgtactcctgtggagagagcttttgggggttaggtaaaacttcactgaagaggtgacatttgagccgagttttgaaggatgaataaaagttctccaggtggaaaaaggaaaagttatatgtcaagcagaggagatggtatgtgcagaagcacatagacatgacagggcttagcatgtttgaggaattttgagaattttggcatgaatgaagcaaagggtacttaggggaattggcaagagatgaagctggtacagtaatttgggccagattttctttgtatgtatctgcctttctttcttttgttgtcttcttgaggaaaaaaaactatcatattaaatcctaaaattctcaagccttacatactgtcaaggcacccagaattgtttgaatgaattggacaaataaagagagag

SEQ ID NO: 139005 - DNA, 1040 bp, Homo sapiens
tcatgccttcattatttgtgaataaaaaatgtatcatggcataacgggcttcatccttgcataactacaaggaattctaatacagacaaaatatttttaccattgcctttgtttatttaaatactaactttttgagcttaatcaatgttcagtttgcttgaaagaagtctcttgtccagaattgcctgcttagcatgatggtttcctcacttcttgtttttaataaatcatttctaaataattaactaggcaatagtacaaactgaaacaatggattagttcttcatggctcctagtaattattaaaaatgcaactctcctgttgactaggacccctaatagagaagcctgatccctggagtgttagttgggagaccaaactctgccactggcttgctgtggaactttaaacaagtcactttagcgtctctgagctttagaattccgtattttaactttgtaataatgccttctctggtcacctcacaaagtagctgtgaggtggatgtgaagcaaagttgaaaggataatagcagtctctgaatataaattattgttgttaaaataataaagtcaagcatttgtttagtcatagcactaaacgaatgtttcttctttcgcggctgcttcatgtttatctgcatcttttctgtaaaccccagcttctcactgtatcaagcaagacaatatatttggtgatacagttcacctctatgccgaagggcagaagcaaccattttaaaaaaaataatgtggcttgctagaggatatctgggaagcagcaacagatgaattgccattttgagccaaatcattttgttgaccacaaggcagaacagcagcaagctcagatgggagaactatagtcattatccaaaggtcagacttgataagcagactctgctatttcttcctctaactcccatatgtctggaggggcatgtgggcggcagggggagccagaaatctcactgtcaaaaaagtatttaagtgattttctgcaaatagaactgattatattctgtgtagaataacaggat

SEQ ID NO: 139006 - DNA, 1300 bp, Homo sapiens
ttttgcttggaggttgtaagaataaatgaaacatggatggaaacagtttgagcataaatacataaatccgaggaattatgactcttcaggaattatttatgtataccagtatttgtgtatttagaaagcccctcccttacccataaacacatgcacacttcaccatcatcatcaaacttaaagagacatgcacacataaatcctcatgttttcaaacatactttttttcctcattggcttttaaaaaatggttactttgaactgtgtagaattggatggacattaatatacttttatctggctatgtatctatttatttattcattaatatagtcaacagatatttattaagttctactatatgccagatactgtaatatgctgggggaaaaatataataatcaagacaggaatgactcttggctcatgagcttatggccaaataaggaagacaacagactctttaaaaagtttaagtactgtaatgggggattgtcagagcatagtagagtacctagcagaaccttagatgtagagggtagaaaaggtagaaatgcttcccacagaagtaatgttcatgctgaggcttttagagaatgagtaattgcaacctagcaaagagaagtggggaagagcattccagtcagagggggcagaatcactgcaaagttgtgcagtaatttggtgtgtatatctatctacacttagatatcaacccatttacaggtagctgtgcctctgcctaaacttggagaaactgcatggcttttcagaccttgtgaattgttggctttgtccctgaatacactgaatggatgaaaccctggcctagcatgaactgcttttgctcgttgattacttttctaactcataaaagtcaagttctcaatcttgaatgttttttagaaccttcttatggttctgagtgttgtttattttggttatcccgactgcagataattgtgtatttgcactgaccatgaatttagatgcttttaacaagtttctgcattttggctgggttagttactctatttagtagagttgtgtccatcaacacacaggctgttttatctatccaagccccaataagtgagtataatttcctgatattaacatagactcagaaaccactggtctatgtgatttgaataatgaccatttatttttaaaccattttaagaccatataaatcactttctaaaattagttgaagtcatttccttcccagactttctaggattttcttccttcactgagctctagctactaacaagctttcagttgtatatgtttgaat

SEQ ID NO: 139007 - DNA, 1066 bp, Homo sapiens
tcaggaagagcaattatggggaaattgaagaaaaggaatggaaagtaattgcaatttcatgtgtgcccagattccagtgcactttggaaaatcccctccgtatctcagatgagttgcaactccaaatcaacatgtaaagcagttattttaaatgtgcaatgctaagactcaagaaagtttagtacctgctttcattctagggtgaaaagaaaattcagtgctgtttgtgtgtgtgtgtgtgtgtgtgtgtgtgtgtgtgtgtgtgtgtgattatacatgaatacttatacttcagatgacgttattaaaacatatgtgtctttcttatgtttatctggcccaccagttagggagttatatttaggtatgtaattcaagatttcctcacacctaatcccaaagcatttgagcataaccaacattttgctaaaagggggtggtgtgtgaaggcagatatgctttctacaggatgaaagttggaatttgagtccctaaaggtttatagacaggcctaggagacccctgctctcaaagccaggaagtaaaatatcatggacagtatttttaatactagggctagatgtgtaggatgtgaaactagtacaggaaatttagaacaagaacatttggcaaccttgtgcttcctgtctaaaataaccattatggaacatcagtgggaggtggtaggctatagtgaattttaacattttttgtattagactgccatactactgaacttttcatatgttatagatttttttctgttttatttttgctttttgttcttagaaaagtcagttcccaagtggggtgtgtgtgtgtgtgtgtgtgtgtgtgtgtatgtgtgtgtgtgtgtgtgtgtaagggaatatctatatttagtatctgcctttaggtgtatttgtttccagagttacttctttaacaactgacatggtattctttgggcaagtcatttattttgagcactgtaagatttctgatgggagtgctgtaagctccagctctaaattgatgttgaagaatcgataaactacttagcagaggaataaatggcttgaggaaa

SEQ ID NO: 139008 - DNA, 1098 bp, Homo sapiens
aaacaaagtctgagacttttattattagaaacatttttattgacctaacagaagcctttgatttagtcacccatatacagtttcttcagaaatcccgtgattctggatttagcagtgaccctgtaaaatggttttctctccatttagttcttgccaacttagcctcgacctggaggtccaaaatacttgcagactgtcatttttagtgaagaataactgaagtctttcgttggctgatggtgaaggagagttcaaagactacgctggcagctccatttgctatcacaggaagtttctccttttgaaatcatctccctctttctagcagatctgctgtgtcaagggtgtgctttttagcagaatttattccttgagttgctttcggtgtaagttatctgcaaaggcaaaacattcatggtaatttatgtgacataacttatttcagtagagtaatagaatggtagagctaaaggggatgttatggaagcttctgcttgatattcttgttttatagatggggaaactgaggcacagaggtgttaaattactcacctgaagccatacaaactagttagtgtcagagcctagagtacaaacccaggcctcgggactcctaatcaagtgtttttttctaatatgttatgctgctttctgcctagctaattcgtgtagaatttacctatcataatatacatacatattacatgtaaataaatattaaatagacagatatgtatgttatgtattctattggtggcaacataacctagcagttaagagcagacatagatctgaattctaccccttaatactggtgtgaatgtatacatctaacttaatctctgagcctcagttgcctcatctgtaaaactgagacaataagagtactcactcacctgttaaaattatgagaatgaaataagaaaatgcatgtaaagtactttgtaaactgccttgtgcatagtaaactctctgtgaatgatagctatttttactatttaacttttttctatatagctcattcagttccaccccccaccgcctcccctccccaggatgagaattcccttggaaatcttaattttattaagctagcat

SEQ ID NO: 139009 - DNA, 1095 bp, Homo sapiens
aatactgtggacagaattcagaatgcattgattaaggagtggatgagaggagaggaagtggaagagcaaatgcaggccacattcttccaagggggtagagtagctgagtggggtgcctttggttcgtttaaggatggatagggcattaagagtttcttttggtattttctttgaattaatcatctcattttctgatttcttatcataaaaagaataaataagccaaaggaatcagctacataagaaatgaagtcttgcatattttcagtgcttctgtctgatattaataaatgatgaattgtggttttaagtccctatagttctatatcttttcctcagctttgcttaaagtgtctatctacccagaatccacaatgcctcaggcagtactaaattagcactataggtgtattaaggccagcctggctggggtgagcacggcattacggctggctttagacccttggttgaggagccagctttgtaatacccaacttagtaattatgggggctttatgtttgcatgtgtgaaccttagttaagctttgtcatagatttttcaaaacagctggggcttttggtctatgaagacattaatttgtgtctccaggggctatgcataaatcaaattggaaaagaggggaggaggagcgaatttctttttttgtgtgaatcccagctccctgttaactgtttaattgaggagaaggaaagagtcctgtgacaattactgaattagtgatgcactattatcttcttcttgatgtattctagcttgatgtatttatgttaaaaagacagtaaatgctgtctcccatagaaggccctgctttgttgcccttcaacagaaatgtagactcagatttcacagttcctgttgtttcaaagggaggcttaatgttggttggtgatggttgttaatttaaactttagtcctcttttcttaaccatctgctgtgtagtggctctcagtcacagttgagggacagcaacaaggatcccacctggggaaagcaaagtaataacataggcctttggaaattctgctgtttattcctctctagccctgtaaaggattattgggaaatcatgtca

SEQ ID NO: 139010 - DNA, 1115 bp, Homo sapiens
ttgtagaaacaaatcttacttgcatgtacaatgttagcttagcattgtaaaagattgccggctgggcgcagtggctcatgcctgtaatcccagcactttgggaggctgatgcgagcagatcacctgaggtcaggagttcgagaccagcctgatcaacatggaaaaaccccgtctctactaaaaatacaaaattaggcgggcgtggtggcacatgcctgtaatcccagctactcaggaggcagaggcaggagaatcgcttgaatccgggaggcagaggttgcggtgagccgagatcatgccattgcactccagcctgggcaacaagaaggaaacttcgtctcaaaaaaaaaaaaaaaaattgccacatggagtgcttctgtaatacacataagcactcttgcttttctggtttgtggattggataaggaaacagtggattttcttaaagtagggcacacctatagtctgtattcccatataaagtttttaatttcaaagactgacccctttgttagaccctgatttctcaacctgatcttccgtagtctcttgtggtttcttcctacttcattagtctagtgactcaggtgagctttcctgacccctgatctctgcctggctatcatatgttatactatatgaaaatataatgatatatttgtgtatttataagtgagatatagcaggaatttgtataggagccctacaaatatatgtgtttttctatcaaagttttatgatattcaagaccagcaagcacaatgcacgttgtgaaagttttctttttttctgtacattactacttattttaaatattcttgttttgcttcttaaccttttacatgatatactaactctatccattaccgaagcataaccacttctgaagtgaaatgacatctatctaaccatgttaaaaatagtattggttggccaggtgcagtggctcatgcctgtaatcccagcactttgggaggccaaggtgggcagattgcctaaggtcgggagttcgagaccagcctgaccaacatggagaaaccctgtctctactaaaaatacaaaattagccgggtgtggtggcacatgcctgtaatcccagctactcaggaggctga

SEQ ID NO: 139011 - DNA, 1428 bp, Homo sapiens
tgtaaataccttggctttactttgagtaaaatgaggagtccttggagggttttgagcagaagagtgatataatgtggtttttaaaaggattatgctggctactgtcttttttgttgtttaaaccactttattggtataaaccactttactggtatatgattgacataaaaaagctatatgtatttcatgtgtacaacttgataagtttggagataagtatacaccacaaaaccatcaccttaatctatgtcattaacctatcaatcacctccaaaactgtcctcccaccctcttatttattattatttgtgtatatgacaagaacacttaacataagatctacccccttagcaatttttaaaatacaccatacagtattgttaacttataggcactatgctgtacaatagatgtaggccttactcatctggtgcgaccaaaactttgtaccctttgactaataccttcccatttcactctcctcccaggccctggaaaccctggtattctactttctgcttctatgagtttgactactttatattcatcatatagtgctatcatgtagtatttttccttctgtgtctggcttatttcattatgtcacttagcttgacattctccaggttcatccatgttgctgcaaatgccgggattcccttctttttaagactagataattgttctagggtgtggttggttgtgtgtgtgtgtgtatgtacaccaccttttctttacccattcatctataaatggacatttagattgcttggctattaagaattatgctgcagtgaacatgggagtgtagatatctcttcaagataatgatttcagatcctttggatttatacccagaagtgagattgctggatcatatggtagttatatttttaattttttaagaaacctccgtattgtgtttcaatatacattttcactaacagtgtacaagagttgcattttttccacatccttgcctacatttatcttttgtttttattgttgttgttttgataaatggtcacccaagcaggtgtgaggtgatacctcattgtggttttgatttgcatttctctgatgatgagtgatgttgggtaccttttcacatacctcctggtcatttttatagatgtctgtttaggtactttgctcacttattattattattttttgctattgcattgtaggagttccttatttatttgtgataataaccttttatcaaatagatggcttgtaaatattttcttccattctgtaggttgccttttcattttgtttccttctctgtgcagaagctgtggctatcttaaaaagagattacaggtgtatgagcaaggtggaagcagggagaccagataggaagttgcttcagtaatctaagcaagagatggtggtagatggaagcagggtggaaactgttca

SEQ ID NO: 139012 - DNA, 1765 bp, Homo sapiens
tacatagcaatgactatgttttgagcttggactttgtattagttatcaactgccctgtaacaaattaccctcaaacttagcacattaaagcagcaagcattatcttacagtttttgtgtgtcaggaatctggaaatggtttagctgaattcctctgccttaaggtctctcgtgagcttgcagttaagctgcaactgagcctgtggttgaatccgaaggcttgactgaactggggagaggatccactttcaagctcgggtggttcttggcagacctcagacccttgccacacgggcttctccatagggctaacccatgaaatgtcagtggctaccccagagagggtgattcaggaaagactgcccaagacagaagccagagtcattttataatctaatctcaaaaatgatatcccatatatattaaactacatatatgtaatcacatttatgattataattatatataaatatatatacactcacacctatatgatttttaaagacacatatttactaaaacacagtctgagaagaaaccgaaaagccaaatgagaaaaagaggtttacatgaagagataattaatcttcaagtgactcttacaactacaaacccacccagaaagacagaagaaaatgtttgacattaacaactccacttaaatttcaatacttttattcaatttatgtaagttaatgtgaaataagatactaactacagttaaatgtagcccctatatatgggttttagtgcatatttgaagacagaaatagaaaaaagtagactaaactggtaagaaattgaattttaaaaacaggtattatagattacctcatagttcatatttcctcttacctttacttctattacattttagtttagtaactgaaattataagaatccgcatttttgtagaatggtaatttagtaggaaggggaacaatgctgtcttgcagcagatctttaaattcaatttttaactaaattaatttcatgaggtctaggttgttctatctaaatccaaaaattataggtattcatttagattcataaaccatatctcatttactcaaaataaaagatataaccctgtcttgtctacagagagtaagaaaggattaaggcaagagagaaaagtgttttattcatcataacaacacaagatgcctatttgaaactgaggaaggagaagatatgtataatatttagaaggagtttatgtgtgtatgtacatttcaaaagggatacacttctgaaatagtcatttctcatttggaaagacagacatctgtgtgctcaaaaaggaaactaataagtgaaaaaggaagagtttggattagcttatgtctgaggtcccacctagctttaacattctgagtccatgtttagattagacattggaggtataaatcttatttttgttaaggagaatgagaaaacatgcataattaaaacctgtagatcatccctaaacttcattttagcctaagctttataagaggcaaaccaaatgtgtttgtgtttgtggtgtgggtgagttttcatggtatcttggcttagaggtaatgggagagggtagtgctgtgtaccttgcaataggaggtataccttattcagtcttttgtgtcctaccaggaaatgtagataattgctttacagacataaaccacttttgtattctctgtagctcaggaattggtcagagtaagaaggaagctgtgattagccttccctgtgcccctcagttattcctttcaaataggctt

SEQ ID NO: 139013 - DNA, 1590 bp, Homo sapiens
tgactggatgaatagaggtatcaataccctagatgagaaagtcaggagtaaatttgggagaaaagatgaattacattgtgggtgtattaatttggaggtatctaggatatcagtaagaaataaagatctgtgggtcaggaaataagtctgcattagagatatagatttgggagcattattagtttataggtggtagctgaaaccatttatgtggattatatcactcgtatagtatatttacaatgcaaagagaaatggtctgagcccaataagaaaccagtgaagtgaccaaagataatggtaaaagaagaaagagtttcaggcatagtgtagaccagtgattctaagtgtggtccatgaacaccgggggctccgagcccaagattcttccagggagtctgagcggtcaaaacaatttaattctaatatgttatttgtctttttcaccatgttgacattttcactgatggagcaaaagcaactgtgggtaaaaccactggtaccttggcggaaattaagagagtggcaccaaattgtatttgttagtaattatattctttattttgtttagatataccacattttgtttattcatttattgattgatatatattgggaatttctcatcttttggctattatgaataattctatgaaatttgtgtgggcatatgtttttatttctcttaagaatatacctaggagtggaaatgctggatcatatgtaactctatgtttagtcatctgaggaattgccagactcttccaagtaattgtattctttactgctgcacactcacagttaagaaaaaaagccattctcagtaatgtcttttataagtcagtaactattattagtttattacattttgacctttatgtacatttttaaatgttctatgtatcaaatgggaagaacacataaagcacttctgatgcatactgaaggacaatggtattcatccttcaataaaccttgcatcctcctatgcaagtcttaaggtaaagcatttgtatggttgagttgcaaactgaactagcagctttttacataggattccaattttacttgaaggaacaactgacaaactatggctattctgtgtcactgggtatttggcagtaattttctcaaaaataaagtgagcctgtgactttaaggaaaacaactggtatttcttgccaatgttaaaatttagaattagaattttggaacacgtatctgccaccatgagcttgagagtttaccaatgctaatagacttctatgatgaggccagtcatgatgttaactaatttgagaatattgtgtaatgaaatgtgtaacattggaagatttgcataactcagtgaaccaatatttgtcaaatgatcaatgaataatgttgtaaaatcatgcctggggaaaaatccatttaaagtacaagactgaccagtggttttaatataacaaagccccaaaagttcattaatatagattcagatttcccatttcactaaagaaactgccactaactgccactgttaaattttgatgtagtattaaagaataatatctacaattatctgaaaagactattcaaatgttcttc

SEQ ID NO: 139014 - DNA, 1974 bp, Homo sapiens
atgtcctgaatggtattgcctaggttttcttttagggtttttatggttttaggtcttacatttaagtctttaatccatcctgagttaatttttgtgtaaggtgtaaggaaggggtccagtttcagttttctgcatatggctagccagttttcccaacaccgtttattaaatagggaatcctttccccatttcttgtttttgtcaggtttgtcaaagatcagatggttgtagatgtgtggtattatttttgcagcctctgttctgttccattggtctatatctctgttttggtaccagtaccatgctgttttggttactgtagccttgtagtatagtttgacatcaggtagcgtgatgcttctagctttgttctttttgcttaggattgtctttcttgcttccttctttttctttccttccttcattgcttccattagcatgatgatctgccatgcagaggtaggttaggaatgaaggtaagtaatactttgtaagtattaaacataggctgatgctgaaatcaagtagagaagagatatgccaccatgcggaaacatgcaatattagacatagggagacatagtttgaaaaagacttctcgaagattctgatatgatcttcagtgagtgctataccagcctagctgaaaatcactgagataaataaaaatgactactgtttcatccatgagaattttttaagcaaccttaaataagttcctatagcttaatacgtgcttttgccttacaaaataaaacagaacaaaactaatgctgaagaaaatagaaacttacttagaacaacttgtcagatggtttctagtattagcaatttgctatgtccaaaaactgaggagcccaatgaggtaaagtagttcttgcacataaaaggaaaggcatttgctacccccagtgatcctgcatattgtaagctctagcagagtgggtggggaaggaacaccattgtctaaaatggacaaatagaagaaaaagtttctaagaggtttgcccagctttaaaaatactttttccacataattaaactaattagagattctgtattgattcatgacctcctcttttaagatataatgtctcatggtgaggttaacccttaaccatattttagcatcaattacttgaatcaaatatctgcatcgattcctaactgaggtttctgttcctcggtggcttagaaaagaaggtgtaagggagatgtgtgcatctccttatctctttctttacctgtttgatggtattatggggagggactttcaaaatgcttttgtgggaaagaactctagtgttgggataggataaaggcacataatattagttaatttgattgtttgtcctcgcccttcacctttgtaaatcgtattcaactcacctgactcaaatcctgtacatcacagaaagcctcctcttcttttgctagcctacattgattttccccttctttgaactacagcagtatttattgtctgtactacccaatctaatgtttgattgggcgttatatattctcctgttctttagtgagtttgtatgtgccaaacttgttcccccttatagaagactagtgatttatatgtactacaaatgactgttgggaggaaatgattgcaagttctttaaggcaaggactgtgactttcttattcctttgtttagtattctccatggcatatagaacaatatatttggatttagggaaaaatcacctttaattactgttacaattaagatttcactcaatattactatctaacttaaaacatgcaaaatttacaagtagatactatgatgcatatgttatacagtaatggctttagtcacttggactaaattggcagtattctttcccttctttgcactagccttagctcatggtactggtggtcattcctgatggccttgatactggctctttctcataacgactagtggaagcatatagaaatgctatttgatga

SEQ ID NO: 139015 - DNA, 1061 bp, Homo sapiens
tgttgttgtgttttttgttttttcttttggatcctagcaagatgccttttgataatggaatagaatgttacaaataggctttgtggcatttcatccttttagatgagcttattgagattttggagttacagatgaatttggcctttccacctgaaaagggtattatcttttatttcattgctttccttcttctgtatctcattcccttgcttcgcactagtttctgcatttgcttcttcttggttattaagctatagttccacatgatttccatagttgacccattcccctccactgttgtgattacctgtgctgccaaccctgtgatgatggcttattggcttttgccctttcttcccactctttactaccaaggagtcaattgatccgcagaacctttctaattccctcacactctatcccctagatggtgtcaaaagtgtcaggtcatgtgtttttcaattacagatggaacaaagtatttaccaagtggttttctaggacatgacaaacacagcctggcacacttcttagttagagtatggagaatagaaagctagtccttaagaatgaagagcattcaatcaggatttgaaagcttagtcaagtagaaagctggtactgtatgtgcctctagcttttaaaaatttctcctcgcttttcttctttttttttgtttgttatactttaagttctgggatacatgtgcagaacgtgcaggcttgttacataggtatacacgtgccatggtggtttgctgcacccatcaatccatcatctacattaggtatttctcctaatgctattcctcccctagtcccccaccccctgacaggcccccgtgtgtgatgttcccctccctgtgtccatgtgttctcattgttccactctcacttatgagtgagaacatgtcgtgtttggttttctgttcttgtgttagtttgctgagaaggatggtttccagcttcatccatgtccctgcaaaagacatgaactcatccttttttatgactgcatagtattccatggtgtatatgtgccacattttctttatccagtct

SEQ ID NO: 139016 - DNA, 4160 bp, Homo sapiens
tccttttacatataggacaagcatttctttttatggataatttaaattttaaaaacggcctaaagtgagttatcctcagaagggatttgacaaattatgatctcaactaaatttaaatgcgagctgcactctgcatttctcatcagtactgtttttctcatattggcttgctgttgagggttggctgttaagtcttgatttctgagctagggataagaaagttgagttaatcagaagagctcctaccttcaatgtttatgtcatagacacttttatacattttagctctcatagtccctttcactattttcttttggattgttcaaccccttagccactcatgactcacaacttttcagcttccatttcttccgcgagtaaatcttttttgaaccagtagtatattcctttcaggactattttgttatttaaaatagcattaatactttggaagaagttgatcagaaatggaatgtagtctgtacataaagagatataaatgtaggtccttttatgttttgttattgtgtggagttcatcaagtatattagttgtacttggtggctttaaaaagaacccagtgtcaaatttctaaagtactgggaaaaaaaaatacatggatagagtaatgtccttgactattgttatctatggaaactatatggtaagtaactatgcctgctggacctgccctctgttgcctagatcccagttctttgtatacttttcaattgctaaaatttttagcacatcctgaaattcccttctttctctttccattcttcactttctttggctctgttttctgtttttaatggacagcaggcatcctccccagcttttttgtaccattcaaactcactcccagaattcattgttgtatccaacctcactgaactgcctagaggagttcaaaacgggtgtttcaaagtgcctctcagggccaccctggagcactctgcatataggttcttttgttttgaggactaaagagacagtatcgcagctacagttttgagaaatgtgtaaagagaaaacccatttggatctaaaggaaaattttaacttcttgcctctcccttcccccagactacatctacaattttcagtgacatttttactttgtttaggaaaccagtcatttctgctttcagtaaaaaaagttcactctgatcaggatccttcctaatttaaaccagagtagagaagaagggaaatatgttttaaaggtatgctataggactatgctaagatatttacataaattattttatttaatccttgttagtactctcaataaatgataaagaagttgttcttcttagccgagactatatataccactaacttgtctagagctctgtctccagaaacactgctcttagaaagcctgcattcctgttgctttttacttatacacataattgtgaatggttacctattctcttactctgtttctctgtgggtatgggtgttgaagagataagatgggagggagggagggatggagggagggagagaaagggagaagggaagagagaagagagattatcagtactaggatgttccctcataaaaatcccagatctgcgtaaaatgggagaatgtaaagaaaacacttcctgtgctagctgtgtattgaacaggaattgggatgtgttttaagagggcttctgactaaggggttgtaaagaaagccttctttagattctttatacactctacttattgccactcgcttgcccagcagtctaagagactgctgactcttgctgccaaacatggttggcattttcccaaaccttgaccgtggggtttggaggtggaacaggaattgcaaagaaccacaagccttacacactctgctgagtcatggaaatttgcccagcttattcattggaagttgtacaatctgcattcacctcaatttgtggtaaggaatatgaggaacgtaaaataattgtgacaatccatatttaataaaaatgacaataagctgcaagtaaatcagactattctggaaaggttttatgggtggcattttacatttcgtcttggttataaatatcaaacaaataaatataaaacatcaaaagtaattttgattcatgcttttatacatctacaagtgacaggggatagtaaactatattaagagtgtgcaatgtgatacatcattttaaaagccaatatggttttgagtaactgacatggatatggacaaataacttagagcatagtagtgagaatccctttttaattggtagtaagactatgcccaagtttccattctctggaactgagatgcttgaaatggaaaagagcaattgaaatgcttaaggaatctagggagagtggtttatgaaggtaggacacaaagtaaatatgataaagacagcttgagtagttcgtgaatattggcactcacggctcttttgaatggagtgagcaataaagagcatagtctcacggaaaaaggaataagcacaggcagaaatatgaccactggagggatgagcctggaattccagtagtgtctctccccatctcaactagtattccctgagtgccctacccatgggctttgtgaggcatttaacaagaagggaaagaaatggtctgagaagaaatggtttgaaggaattgaagtgagaaggacataattgttttgtcaaatattaacagctagttaaaataaaaggaaaccccaccccgaagcaaactctccagaacatttctttggctggcctcacattaaggccagatgaagcataagctgtagagaagaacctcactctaacatggaatatgatctaaggcaatgcccttcttggaccatctccacatggatttattactggaagtaacagaagggctatgttagaacattagaacacagttccaaggcatgaacactgaggttgggatttatagtaaggctctggtgtactagctggacaatgagtacaatttcattgcagatgttttccattggagatttttgacatgtcagtgagccaggataagtcagccagcactacttagctagcacctactgtattgtgttgcctgtacttgaccaatccagtgagggaagtatttgaagctctttagccatttctgatcctcagggcactattgataagctgcccctcccaggatagtaaactgccccttgctgttgtgaaacaggtgatggataaacagcttttctcatagtatctgtacttctctcttttcagtatcggaatcattcccagtaaagtgtaaaatggagtagacgactccccatgaggttttaaatctagatcataatggaccacctgccaaatgctttccctttatgatcccaagttaaagttattgacagagagaaaagcattgcaaaatggagtgccagtttcttatggcattcatggacttaagccaaaatatttaaaacgctcagacaaatagttcattcaggagctttggaagcaacttgtaaaaatcaacagcctgcctattccatatctggggaaaggacagaagagggaggaaggagataaaagagtacggaatgatttgtattcattaactattatcagtgttaagtacaatgtaggatgttgttcttactaacatttacgaaatgctacccttaaacctgcagactaaggaaagagcaatccagtagatgtgccctttgctaaatgattgagccagaaacagcatataaatattagaaatggcttaaaccacagcatcaagttttattatttcgtataataatacgactattgggacttatgactctagtgggaatatgtaagtactcatttatttccagctaatgagaaaattattaagaaagagaaaagggaggtttatagataaaagttcagaaggattttgtaatataagcattttaaaagaattttatggttgtaagaaaccttaaaggttatcaagtcattttccctcactccctttcatacataatctattccctatatctactccatcctcaagtggtcaatccagtttatgcttagatactcccaataatttaacagtctctagtatacggtaggaaatctgatttttgaatagctcaagttattgaatgtttgcataaataagccaaaatctcttttcagcctctattcagctcctactct

SEQ ID NO: 139017 - DNA, 1026 bp, Homo sapiens
caaactaacatttattgaaagcttgctctgtgccagatcatgttataaataccttatatgtatgaactcatcaacgctcacagcaatgccataaggtagacagtagtatttccattttcaggttagaaaaacagatacagagtttaagtatccagcctaccacgtcacacaattactaagtagcaagaatcaatattggatggcaagtttgtcttcagagccaatgctcttaaccactgtggagtatgctgtatgtctttaggggttctttattaaagaaactgtttgcccacctgtgtgctacccggagcagatatcccattgttcatgacttcaaaagacctagacagtgtagagctgtctgctgaccagactattaaaaatttttactttctttccaacccccatcgttggtagtctttactgacaaagtgaaggggaacattgcatccccaggaatttctaaacattgctactactcatgttctttcttcagattttcagctttgcttttaaggtctctttcataatctgttgcttctctccattctcagctttttgcaacaagaaacattgacagccaaagtgtaatttttcttccatgcagccaaatggccaaacatcacacatcttctctgtgtctactctctcccgactccattttatgcctaactgttagaatgttcttcctaaatgcagatcttatcctatcactcctctccttaaaaatcctctaaaggattttgcttttttttttttttttccaaatagacattcagggccatccatagccttgtcccaggcactcagaattcccttacactcttatctcccactacacaacgctctctatatcttatttacctgccactctagaccacttctgggtcataagtacaccccaaattttcaagctcctgtgcctttccatactgttctctacatttcaattgccatccttccttatctccagcgatcgtagagctgctcaatatttaaggttccactcaaattatacctgctact

SEQ ID NO: 139018 - DNA, 1064 bp, Homo sapiens
atcttttaaaatttccaaatggtttctcaattttaaattaattagttttaagggaaaaaatgctttttgtcccactgaagaaaggaatactatttaaagccacattatcaattcatcaaatgaacccaactacttgaatggctcatacaagctctctggtaaaactttctttaggaccccttcagtaaacattcttgaaggggccatttttatatctgaatttattagagactgtcccgtgtactagattaatgactcgatgttcacgccatagacaactcttcttcagcatttgacaatgaacatttgagaatgttgataagaaaatgggccagagatagagcaagtattgttataatctgtttatgagactttaagatggtaatgaatatattatctcagataccatgtaattggaatttacccttatctaagatggtatctttatattttaacatgtcttaaagtaaatctgtcctcatattatttccttctggcaaaaaagaaaggaggatgatatgaagcccttttatcattctttagacttaaatgaatttgacacttaaaaaatacaggtgggaacttcggggaacagatcaggattagaggaaggagaactgggcaaactaggcatgaaattggaagttccatattaaacttggtttcaggtggcaaatgtcctacgtagttggaagctctggctaacatccctcactgtgttcctttttctaggaataggcactctgaatataaatgaaaaagaatttattggggcttttaaagaaattgacattttcttattggctaaagaaaaagtctttcatctacaaaatagttactttttccttgtcttgtttgaggccaagaaaaattcaagagggagatttgtaggttctggttgttcagggagctgaagttgagtcgtctgatggattttcctctttggtacacctatgagcgtgttttagaggagtgaagggcaggtctcatggacgggaatataaaggttagtatacaccagtccgtggtgtgctggagccagcttgcactagcttatttaaggg

SEQ ID NO: 139019 - DNA, 1040 bp, Homo sapiens
aatattatgctcctacgcttaacagctaaaagatcatgttctattttgatgcgtggtttgacagttgatttcgctcctcattaattggacagcatgcagatgatgtggagaagtgagtgagtgacaatatttcaaggttacgttgaagagcatacagtgaaccttagtgcctggaccaacagctgctgaattgaattgtctgcaattaaagcaacagcaggtttgtgtagtctccctgcagcccatttatttgaatttatagcttcagtttcttctttgagtattggttggttggttctgctaagtgttggaaagttgtgcttgctggatgttttctctgtattccaatgcatgcttgactctagaagagccttctgtgtacattttaatgtgagaagttgttgaggcttttttcttacggttaaaaccagagattgtcttattttctccactataaaattaaatagatttacatggaaaatattgctttgttgaataaatagagatttctcatggaccagtgttactggtttaagtttctggcaatgaaaaatgctggactttgttatgctactggaattactatatctgggaagaacttctctctgctaataaaaatgtttacattttaaaaacgacattatctccttgccagctctcaattccacagtgacctaatgaataatttcaaatctaactaggtggcttttatgactgtattttatttgtatgctaatagtgaatacatgtttaattccttaatggttttactctattaaaaattacaatattagtgtagttgttggttactgaatgatagtggatgtggtataaaacatttagacagtgatttaatatatactttcttagttcattctcagtaagtgtgaggtcagtgatatgatctccattttataggtaagaaaactgagactcaggatgagtaactggcctgaggtctccatctaagtgcagcctaaacttacaggttacattatctgattaaagaatctgtgctttttcctccctgatatcaggct

SEQ ID NO: 139020 - DNA, 2481 bp, Homo sapiens
tgtttgagggcacagatagcactggatgggaccaagaggagctgacatctgatatccctgctctatcccccacctttcttttggctgcttcagatttggttcatgtggacaaacacacttgggaaccaccatacagatggaaatcaggacatgtgggatttggctgaaccaaagatccccaaacattgcctggatcatttagtgccccaggtgtggccaccccaggacttcatgtgctaaaattgtgtcccagctgaagccagctggtcactgtatacataggatcaaggcagcttggagcctcataaagcataactttggatttttaccttgtggatttagatttagttaatcaccttgaatcctcccccaacacactgggcaatgaggatgtaacaggcaaatagaaagcttgaacaaaaggagatgctcattatctagtagtttgcattccagatgggacataatgctagaccatatgaagaaaaatggactgactttccagaaaggaaagagagaatttagagggctccagtctctttaataaacttttgatgtattattttaaaattttctcaaaaacgttccctgctatagaattttaagagcaaacagcgattccgtctaatttaaaaattgtaagaattgagcagtgtttcatgaaattatattagttctttctttttatttgccttatgtgatagaggtgcctcacttcaatcattaaggcaagatttgtttagggcatggtagtaataatcccatacaattgtataaccctttacaatttacaaaagggttttcatacctattatctcattagctgttcacagcaatcctgtgagacagtcaggataggtactattatctccagttaacaaataaagggaacttaggctcaaagaagttaagtgacttggccagagtcacatagttagaaagttgtagaactggaagctgaacccaggtttcctgatacccagccccagtgctccttcggttgtatcatgtttcctcccaaagacactatctcctttttgttcctactcgtgattaattttaaaatccgtctaaaaatgagctttagtttagtggatgagtaaaactgaagcacttacatgtaaagtgctttctcaagtcacctaatgaagtgggtcctgcacatagctcttggcttttcaccttcattttaactgaactatttttaggtagacatagatttgtttttcagtgttaaatatatggacaaaagttgtgtgatccactgattataggtgtgaaagctgcgcttggggaatgggactagggatgaagaattgccttaaaataattagcttcttgcctttgtgttaagagatgtcatgttcaatagaatttaatttctttatacttcctttgcttccagccttttaaaaatacaattctttagggaaaattagcaaatattcattctgaatgttgatttctcaggaataagggtagccagaggaaagaaaaagcaaaggggtgactttctgtgccctgtaagagtgggcaaacattattttgtttggagctgtgagctaagatttcttccaaggcatgcaaatcgtaaagttctgatttgtcaactgcatgctgtttctttaggcactgatgtatgaaatcccgaacgaattctccaatgaacatactgctaattgcttctccacctgctctccaacctcctccaccccaccccctccactcccaattcagcctataagtgtccgtcattggagatggatggtgacacatgcagtaatagcaattcataaaagccagttccagcccttgtcttcaaggctcctggattttccactgcctgcttttgtgtaagtgaagtggatggaagtgctactggcatcagaatcctcctccctatgctccgttgctgaagctcagttgctcggctggagctgagctaaacagaagcgtcagatctaagctgaattatagctatttttctttttcctcaatggggtgggtgggttagggatagggtatagtgggggtttggggtgctttggcttttcttcttgtggagagaagagggtaaggagagaataactcacgataggatacaacgtgaaacagttccctgaagagtgtcacaatgttcctggtacaatatacaggtatagtatgttttgttttatctgaatttcccctttgtttcaaagtgcatttctttcttttatttttccttcagttcaactgtactgaaggacaaatagggttctaatgagctaaacaaaatagctgcataaaacatgcctgcccccagctataatgtttgtagcagattgctgtataaaatctgcgttttctgttaaactggtagtcccgatcccttaattgtgcacgcttctctgctgtattcttgtattgaatttctcaagtcttatgtctgcaactggtagtatgtgatatagcttagagtgtttgcacagaagacagtgc

SEQ ID NO: 139021 - DNA, 1073 bp, Homo sapiens
ttttaaattttactttaagttctaggatactgtgcagaacgtgcaggtttgttacataggtatacatgtgccatggtcaaggatctagaaccagaaataccatttgacccaagcaatcccattactgggtgtatatccaaaggattataaagtccactttctaatttggcagtctttgagaggttttaccctaatcacttgctactattcagcaatgccatctctgctagggtttctttccatatacagagatcactttgaacaattgtttccttctgcacacaggacataacttcctgcactccttcacatgttactcagatgaatattcattctttccaactcaaatcagtgattccagcagtaattgaggtttgattatcatgaaggaaagaaatcagttttgaagcacagcagcttcatttcaaaagcattctatgaggcgtatttattgcttgctgagtcagcagggctgaggcacgtgctggtcagctgcccttgggatttgggggaggaaaaaggaaaggctgaagagatgtcaggaagtggctatttgaaaaataagcagcaaccagcatgttggaaatccttaaacgtcacatccagatatgggaagtggatagacgtaccagatgtacatgaatataaaacaaatgcatgttgaaggtacctgtgcccaaacaaattgtaccatctagccagtcagttttagatcatgttctttccctgactcagatactgtaaatggcttcccattatccataggatgaagtccaaactcttcagcctgacctttagtactgtctgcaatctggctccaacctacctttctaatctttgtacttctgtcttacagaactctgctccagccagttaccctttcagacactgctttggcattccattacttacagtgggagccctctcaggggctgtattttttacttctttgaattccccaaagtgcctagcacagtgtcttgcatatagtaggcccccaatatatatctgtgactgttatttttccccacccttccaccattgtttccaatatctctactattaacccaatg

SEQ ID NO: 139022 - DNA, 1030 bp, Homo sapiens
caaaacatgctatgtttctatgttcattaagattacaatggaagctatagttaccactcgagtggatttggattacacacaaacatccttcccaccttactcagtgtccttgagagcagtagcacaaatattcaaggcactgattaggaatatgaccatgatctgtgacccttaggcatgcaagaaattcctcagcctttaagactcagctcatatgtcaacacctctgtgaagccttcccgacagcccttgcccaacatacatgaatgcacgcacaaggcaatgttaggcctcgggcttccacaggaccctgcacttagttacctccgtcctagcctgtaccacactgtagggtgtcggtctgtggatgtctctgtgttccccactagactgtgaactccttgagggcagggaccaggtttcattcatctccatacccatagcatccagaagagcacttgacacatggtagtcacctaataaatggttattgggtgaaaagaattgataaacagatttgcatgaatataactggggaccttggtagcacagagtgccaaatgctatgaaaagactagctgtttgctacatttgctacttttgctgaagaaaggagtaaattaaagtgcccataatttcatgaaagacctactttttccctcttttcttcactctcccctggttatcttacctttttctttcctatcatttacctatccaggcacctattccttagccctgcccattactttgctgctcttgacagagttcatcttcctcctgccctgatactttgccaggaaacatccttccttctacccacccaagtccagtacactccgtccttgacatcactctcaagttcatctcctactcatagactctgctgctgggactataatttgatacagctcttctggagagcaattcgtcaatatgtatcagaaaccttaatagaatacagcttttaacctaccacttcaacttctagagctctatgctgaggaaacaatcatgatgtttccaaaaa

SEQ ID NO: 139023 - DNA, 1850 bp, Homo sapiens
gttcatctatggaagttcaagcctaacccgggaagtgctgaagccctcatccggctttcaggctttgtgaaggaggtgaattttaatctgggctccagcagagtacaggggatttgaagttgtcaaagaggagggagaaaatgcttcctgctactgagattggactttgagaagggtaaacagaagagggagcactgtgagacaggtgggcttgcctgattggaataaaagatatcagcacaaatatactgggaaataaatagggtggagaagcttggggtcataataacatgatactttgaaacatacacatagtttggatattattctgtatcaaataaaattgaaggcaaaaattaagattggatgatttttcttttcatcctagggaacctgatttgagatcaattcttggagaacacaaagaagtgtgatggtatgttccaggtgtgagtttaaatccaagaagaagcttgtcttgcagatgttttgtttgtagctattcttagctacagtctatagctgtcaactttaaagcctagagacatcgatatattttcttaagaaatgcatttgctgtccccgtgcatcacattatctgaactgtagtcatctcattgggtgacaataatgactgctatttattgaacccacataatgtcctagtcatcatcataaatactttgttgcattatcttgagtgttatgaagtaggtactattattcctgtttctttttctagaagaaaacactaaaatgcacagaagttaaacaatctacttaaagtcacatagattataagttgagttgaggtttgggtgtacagatttctgactccaaagcccatgctctgttcaacatggtttgctgctcccaatgttctttcttgttcttgactttccagttgtggtaaggagagataggtatagttcatcatcctggccaaaacccaaatgattcacttaaaatttctatgtcagaatgtatttgctgtaaagtagctgccaaaaccaaattaactgtcattgcaactgtagctaattgtgtctgccaaaaccatagtcagtacggctatttctgaattagatgattctctttataacacatatcatacctctaagctatttggaccttgatagcactttggatgtattttattttagcattttaagaagttacctgggacactagatctctttcatgacctctgcccacgtgaagtgttggagaaacaatgaagtacaaggtgtgaactcttcctggggtctagctggggagctggatgcccacagttctgagatactgtagtgtgtagtataacagagacaggtacaaaatgctatggagggataaaggaaggtgtgactcactgtaagggagactcggggagaaggcttccatgaggaggtgacatgagataggtcttgaaggatagtgagtttgccccaggcagggaaggagtggaggggaggcatttcagatagaggagtcagtctgtgaaagatgtgtggctgtataagagtagggcatgttcattcaatgtggaagaattcagcatggttggagtgcagatagttgagtaaaaggaaactgtaatgggtaggagaagagtctggaaagaggttggggctgatttgcaaagaaccttgattgcaatcctaagttggaatgtgcccccataggtcagtggttctcaaaacgtagggcatctgccagtggtagttacactgtgctcccacaaacattttaattttactagttacatgttcaaatatgtcttaaaaaacataaaactgaactaagccatcacatctaagattactttggattttacttcataaaaatagaaa

SEQ ID NO: 139024 - DNA, 1023 bp, Homo sapiens
actgctctgcactttttatatatgtgtcctgtcttctcattagattgtaaacccttaaaggacagaggcagaaagttgtttctagctgtatcctcaagcacccagcataattcctgtgcacacagtcagtgttcgatgaccatcttcacaggataaaatccaagattctcagcatgaaattgaaggccttctattactctgttcttgtccctttctgcagtctcatctcccatcaggctgcaactcacaatttgccacattgtaccctgtgcatccttattcatgccctttgcctggaaaattctgcccatatttatatttcacctggctaatgcccctcatcttttaatactcagatccatcatcatcctctccagcaggacttgcttgaccgttttctcctatccaatacactgaagcaaatgatgcttttctgtgtctctacgggattcattgtagatatagtttaataaattattattttatctggttgtttgccagtgtctacagtgcctaggagaatgcttgggatgtgggagccactcaatgaatattttttgagtgaatggctcaattgtttatgtgccttcctccctcactaaactattgttatttccttgtcatcaagtaccacctatagcctgacaatccctcaataatttaacactgtgataaatgttatgaaggaaatgtataggaaggtatataacaaggttatctaatttggattgggttaggaatatcagataaggtttatctgaagttatgacatttgaacagagaactgaaagataaacagaaataagccaggcaaagataggttataaggtgaaggggggtagcagaggatttcagtggcaggactagctagcaacaaggtctgctgtggaaaagttcttagagtgattgggaacagagaaaaggctagcatggttagaatgcagtgatcaagggagagagtatcatagatgggactgggaaggtaggcaggaatcagataatgcattgcttcactagatttct

SEQ ID NO: 139025 - DNA, 1086 bp, Homo sapiens
ctcttaagcttggagacttcacacttatcctttcaggtagaaaatctgatactatgggaaagtactggatatagaatgttgagcagaactgcacagattgcatataatgaaagcagaactccatagacaaagtcaggtgtcaattaaatttctgaaataacaatattcctgatgagggtgagtggttttaggtctcagtttgattcacatggaaaacaaaagcggaagttgagtagtaaggcaaggttgcccccaaactggacaaaacataaggcagccatgtttgccggagttttttcagacacgaggggcgggagaagagggatctagacacggcttcttggcgtttctggagcactactgccatcgtgaggatgaagtttcatgaaaccctacgccattacactgttctcgaattctggagaacagtatttttctctctgttggggaaattctgatctgtgggaaggaggaagaggcgtggggctccaagctaggtcttcttgccttctcctctaagaccttaagatagacctggacattggcggtatcttggtgtagaacctggagagtgaggacttagaatgaaccagcccctgccgggcggtcctggcacagaaagtcgtggggcggggcctcggttcctcctctgggcaggactgcaggaacccgctcaaagacaaatgcaggctcttgtgggcatctgtctcctgttcctgccccttggagcaaaagtcagtaggttttcacatggtattatcttactacgggtctttggctctcttgtggcatcagtatccgcgcacaataaacaacgttcttccaggggaggtttacaggatttgctcttagaaccttcactctccaggttctataccaaggtaccgccaatgtccaggtctcttttaaagcctcaaacgagactaagcaaggactcccagcatggaggcgaaccctcttccaccttttaccagaccacacctgccccaacaggtagtcctcactagaactctttaatggcgtagggtttcgttaaacgatatcctcacgatggcagtagagctccagatatgccaataaacctca

SEQ ID NO: 139026 - DNA, 1026 bp, Homo sapiens
taaaagagacgtggacattggcggtaccttgctgtagaacctggagagtgaaggttctaacagcaaatcctgtaaacttcccttggaataactgtgttccttgtgagcgatattgatgctaccagaaaccccaagacccatagcaagatgctagcaagtgaaagcctgctgactcttgctccaaagggcaggtagaagagacagatgcccacaagagcctctatgtgtgtttgactggttccctactgtcctccccacaccggaggaaccaagtttccgctccacgacttcctgtgccagtacctcctggcagctgctggttcactccaaaccccgcactctccagattctacaccaagataccgccaatgtccctgtctcttttcaggccttagaggaaaaggcaggaagacatagcctgggggcctacagatcagcctttcccccacagggaggctttccgagaaggacgccatgatggcgtattccgtctttaaacgatttcctcacggtggcagtagggttccacattttcaatcaagccctgtcttggagcccttttctcccgccctttctgtttgaaaaaacgccttccagagataaaggcgccactgaacatggattactggagatttgtccagttgggtgcaacttgggtttgtgacccgtagagggtcaggattgcaagttgtccaggttcttggcgttttgaacaaataattgcataaaatgcccagcaaagcaaagcaagaatgaagtaacaaaagaatgaaagcaagggtttactgaaaacgaaagtacactccacactgtgggagatggcctcagcagaggctcaagggcctggatacagaatcttctttggttcaaataccccctagaagtttcccattggccacctcatgtaagtggagtggtcgcccgaaataaatctgattggttgcagaaaggagacaaccagaggctaaactgaagttacaaaggtcacactcctgtgcaaatatctgattggttgcaaaaagcaac

SEQ ID NO: 139027 - DNA, 1081 bp, Homo sapiens
tgttaaatgatgagaccatgagttgaaactctgagtcaccttgacaggaattgagcatatgtactatgagtatcatgccatgtggagtatacatggcatgcaataaagagcgtcacctggtttctcctctaatggctcatgccaaattgttgcctacgatgtaccacataaggctcttagaataggaagaattccctggatgcctgacaggggagccagggccaagatctctgggatttttaaattgttgctggagttcctttccaagctttcagcccttttctcctttttgtgcgttcatacactgaagctatcccctgaaaaagacagtttgatgccacggaaattattggacctgtaactctgaagtaaatgaaacccacacagactaggtcagtagaataatttcttaaagaacaaaattcctgatgagggtggttggtttaggccttggtttgatttcaagtggaaaacaaaaagaaaaagcacagcagtaagaccagctggctccaaactgggcaaaatagaagacatccatgtttggtggctctttgtctatgtgtggcgttttttcagacaggaagggcgggagaagagggctacgtaacaggacttcttggcatatctggagcactactgccatcacgaggaagacgtttaacgaattatagtcgtttaacgccattacagagttctctgagcactacctgttggggtaggtgtggtctggtaagaggtgaaagaggcttggcctccatgctgggcgtccttgcctacttgtctaaggccttaaaagagacctggacattggcaatatcttgctatagaacctggagtgtgaagcttctaataacaaatcctgtaaacttccctttgaataaacctgttgtttggtcacagagacccaaagacccatagcaagatgccaacatcagaaagcttgctgactcttgctccaagggacaggaagaagagacagatgcctacaaaagcctcaatgtgtgtttgagtgggttcctgcagtcctgcccacaccaggaggaactgaggccccgacccacgacttcctgtgccaggaccg

SEQ ID NO: 139028 - DNA, 1026 bp, Homo sapiens
accaaggcgggcggatcacgaggtcaagagatcgagaccttcctggctaacacggtgaaacgccgtctctactaaaaagtacaaaaaattagcagggcgtggtggcgggcgcctgtagacccagctaggcgggaggctgaggcaggagaatggcgtgaacccgggaggcggagcttgcagtgagcagagatacaccactgcactccagcctgggcgacagagcggagactccgtctcaaaaaaaaaaaaaaaaatacacttggtgtgatccaaatcacagtgtacacagtaatccacttttaacacagatcaagattcctgatgagggcgggtggtttaggccttggtttcatttgaactggaaaccaaaagaaaaagctcagcagtaagactagctggctgcaaactgggctaaatgtaaggcacccattctgcagggcctttgtctataggtggcgttttttcagacaggaggggcgggaaaagagggctctggaacagtgcttcgtcccatacctgaagcactactgccatcgcgaggatgttgtttaacaaatccctacgccattacggtgttctcctgaggactacttgttggggaagttctctgtggggaggtggaaaaggcttgctccatgctgggagtcctagccttctcgtctaaggccttaaaggacaccaggactttggcggtgtcttggtatagaacctggagtgtgaaggttctaataccaaatcctgtaaacttccctggaataaacctgttgtttgtgcgcggtactggtgctaccagagacccaaagacccgtagcaagatgctagttcgagaaagcctgctgactcttgctccaagggacaggaagaagagacagatgcccacaagagcctccatgtgtgtttgaatgggtgccttcagtcctgcccacacttggaggaaccgaggccccgccctacgtcttcctgtgccaggatcgcctggcagctgctggttcactacaagcccctcactctcctggttctacacca

SEQ ID NO: 139029 - DNA, 1002 bp, Homo sapiens
actcttatgttagagccccactaaatagcgacctccctctcaacatacaaggcctactgactaggtctgaacatggagtaaacctcccagggaacctgggtagggagtcaggagaagaaacacgtggcctggtgcccagatttgctgtcctccaagacctcagatgtcaacatgttttttttcctttctctttagacatggatccctgaggtcggtccccaatacgacaagacaatttgatatcataatagaacactgcagaaacaatgctgagtgaagaagagtagaaatgggaagacttggttgagcggaaactgagttcttgaaaagaggagatgcttgatgagggtgagtggattacacctcagtttaatatccagcagaagccaaaagtggaataccattacgcaaatgtagcaaaatgttaggtagccatagtttctggtgtctttgtctcttcttggccttttttttgaaacgtgatgggcgggagaagagctcctggagcaaagttagttggcttttctcgtacaatactgccatcgtgcggaaatagtttcatagcgtccaaagccgtgagcgtttcctgcatgtaagccctagcagttgcggaaggaaaagccacccaagacacaagttggcattcctacccttttctctgaggcctagcataagcaatagacaaatgcaaagtcttagtgaagtatctgctgagtgagggaccaggactaagccaactgtttccaggaactcctggtacaggaaatagaggacagggcctcagtttcctcatagtggggacaagactagaagatgacagagccaagtgcagacccctggggcatttatgttatgaatatgcccttgggagttttaggcaatctggctgtccctgtgttatgcagctgtgacatttatagcagcatcgttagattgcaatggacaggacagttccagggacaatctatctgaagccagtgtcattcacatggtcctcgatac

SEQ ID NO: 139030 - DNA, 1023 bp, Homo sapiens
gtgaatgtactaaatgccaccaaatttgaacattttaatggttatttttatgttacatgaattttaccaacacagtttcaaaaagtgccaatatttttaaacctatcattatttccaagaataattaattacatttgaaaagtactcaagttatcagtgaagaaaacttgtttcaatgattatactacaggggaatttgaacattagtttataaatgtacatattatatgtgcataggaaagagatcataatacatagcatagatattttaaaagtgattacttctcactaggtttgacctaccatatgttttctgcttgtaatttcttaaagtttttctagagtaaaatataaaaaaactcaagcactcaaaagtatatattgatatggatatattcaaagattataaggtgatgccgaagattttgtacaaaattgcaaacagtatgaatccaattatattgaatgtaaaatgtgtgtgggactgtgtgtattcatatctgtttatatgcatatacagatttaaaaatgccatatatatatttttttagacagggtctcgccctgtcatccaggctggagtgcagtggcatgatcgtggctcacagcagccacgacctccctgggctccggtgatcctctcacctccacctcctgtgtagctgggcccacaggtgcatgccaccacgcacaggtatattttgtattttttgtagagacagggtctcactaaattgcccgagatggtctcaaactcccgggctcaagcaatcctcctgccttagcctctcaaaatgttgggattacagtcgcgagccaccacacccagccaatggcatatatttcaaatcatggtcagtgttatagtgagtatatgtttgaatatgatatttttggccaacaaattcatatctttaattcatagttatataaacagacattaatgaaacattgtagctgcatgtgagtggtgtgaatacatccatcttacagttttcttagggttcacatctaagtgactga

SEQ ID NO: 139031 - DNA, 1788 bp, Homo sapiens
ctgtcttggccttctcttcctacttctaccaaacactttctgacaattcatcacataaactgagaaaatggaggaggactccctggttgtctggggaggggaataggtcaaagatcacctagacttgtgaattggtggctcatgatgatctccaggcttctgaccatttattatcgcttttcttctctgatcggtctaatttccggcctgagacagacattttgataccatgtgaaagtactgagccaacccacatagactaagtctggaaaacatttaatttcttgaaagaacaagattcctgatgaggatgggtcgtttaggctttgacttgatttcacatggaaaagaaaagcaaaagtacaggaatttgcacaggttgccccaaactgtgcaaaatgcaaggcagccatgtctcctggcgcatttgtctctgggtggcgttttttcagacaggaagggcgggagaagactgctccaagacagggcgtccttgaaaatctgaagcactactgccaccgtgaggaaatcgtttaaagacagaataggctattacagcgtccttcccgggaagcctcgctgtgggggaaagtctggtctgtgaggaggtggaagaggattgggctccagactaggtcttgttgccttctcctctaaggcctgaagagagaactggaatttggcggtatcttggtgtagaacctggagattgaggggcttggagtgaagcagcagctgccaggaggtcctggtacaggaagtcgtgggtcggggcctcagttcctcctggtgtgggcaggacagcagaaaccctctcaaagacacatgtaggctcttatgggcatctctttgctgttcctgccccttggagcaagagtcagaagttttccacgagctgtcatcttgctatggatctttgggtctctggtagcatgagtgttgcgcacaattaacagggttattccaagggaagtttacaggatttgctattagaaccttcacactccaggttctatagcaagataccgccaatgtccaggtcttttttaaagccttagaggagtaggcgaggcctcccagcatagaggccaagcctcttccacctcttaccagaccagacctgtcccaacaggtagcccacactagaactctgtaatggcgtagggtttcgttaaacgacatcctcacgatggcagtagtgctccaaatatgctaagtagtctggtcttggcgccctctactcccgcccttcctgtatgaaaaaacgccacgcatccacaaaggcgccaccaaacatggctgccttgcatttagcccagtttggggccagctggtcttaccgctgcacttttgcttttgttttccacttgaaatcaaacaaggcccgccttcattaagaatcttgtgctttcagaaattaaatatcctcctgtccaagactttgagggtgcgatttatttcacagagttaaggggccagtacacttcatggtataaaattatctttttcaggggatgaaggcacaaggagaaaattacttgaaacttggagatcttctctggcaagcaatttacaaattctggtgttctttgatctggctccccgcccagacaaccagggagttcttcatgttctagcctcatgtgttgcactataggcagtaatttggcatcagccatagaggagggatccgatagttgtcattgctgcccgccacatatactccacatggaatgatactcataatgcatatgttcaattcctgtcgaggttacacagagttatatc

SEQ ID NO: 139032 - DNA, 1017 bp, Homo sapiens
tattatttaacacaaaatccaattagctgaagtatgtttagtgacattttaagtaggctttctatataaaacctgagaaaaatgatagaaggaaaaatattaaattagaaggaaatttcacataaagggtgttatttgatgtttataacaaaaaaaaattcctgcacatgtacattccctctaccccccccaataaaatgcaaatagaagaacgagctaaatgcagttgagaaaaacagtaattgaattttgattgagtttatgtgatagagaatatgtctcattaacttctgctataattgttcaatttttcatttttttgctaagtgtttatatcatccttaggatttgagcactagttgattcattgttatttttgaacaataaagaaatgttatgagagttagcaataaagtactattagttactccatgccattggaaatttcccattacctaatattgtgtgaaatattcaaggcattaaatactacctatagtttgatgaggatggaattgaagggagtaattaatgtgattgtgtgtgtatgttgaacactttgttgtgcaaataagggagtatattaataagcctctatcgctttagttaaatagtatcacctctcatgaacaatcatagaatccatttataatatttgaatgcatgtagccatcaagctgctgatggtggttgcttcatgaaaatgggatttacgatgaagtgtttttgcttgtccttcacagatttgaatattctaagagatttctcaaaaagctgatattcataatttgagaagcaatcaagaacaaacgtgtactgaaacagttggtgcaaaatccttattgaccacagatggaattcagtaatttatatttcttcgaaacatagaaaaacggaatactgagatctggtggggggccggcggcagtctgggagcggcgcgccatgtacaccatcatcaacgggcccagcaagttggtcgcgcagcgccgcacaggtctcacgcagcagcaggtg

SEQ ID NO: 139033 - DNA, 1060 bp, Homo sapiens
agccccacctccaggacttcctatgcatgaatttcctgcctactccccggtcagttctggccacttctacaactatatcacacctttgtccacagattctagaaggtctgagagatgaaggcaaggacatcacgcttgaggccagaagccgtcccaacttccccacaggtgcaaccttccttgacatcctggttttttgggaggaattgttcatggcttggattttcatcaactgatttcctcacgatggcagtagtgctccagaaatgtcaaccagccctgtccccagggcctcttctcccgcccatcgagtatgaaaaaacgccaacaaaagacaaaagcacatggaaacaaaactgtttcaattcttgcccagtttgaggaaacttgttcacaccactgtgcttttgctttctatttccatcttaaatcaaaatgagtccttaaccaccccgccctggtcaggctcttccgttttccagcattaaatttccaccagatctttggcttcacagttcagctcttcttctctcaacattagttcttcagcattttctcaatttattaagttgacttcttaaagttgaacaagactcaggattccaggatgaaatgggagaagaaaacgccgtaagttccaggcctggaaaaggtcatctctagtcacctggcatcatggtccttgacgcagctttctaggttaccagggaatcttcctccattttgtagcagacactaatctttttgtttggtggaaggctgttatttggccgaattcctgagattattttcttatagcctatatagctctcattggtttgacatgtcatatgtgacataccaaatgtacctttatatttatttatttattttcgagacggagtctttcactctgtctcccaggctgcagtgcagtggtgcaatctcggctcactgcaaactccacttcctgggtccaagcgattctcatgcttcagcctcccaagtagctgtgactacaggaacccgccaccacgcctgactaatttttgtgtttttagtagagatggggttttaccat

SEQ ID NO: 139034 - DNA, 2738 bp, Homo sapiens
atcacagaaaacaggtgtattcaagacacccacattttaaaaatccttatctgcttcagtgggcattacttgtggcctcactgcacttctttgtacaaggctaatgtgtctggttattttgtaaacaggtatgcttaattttaggaaatgcaaaaatatgagaagcaaccttaaaaatattgcatattccaaggagtagttaatgatgtttccaaagacctcaaactgtcctgagaaaagcatgtctgacatacaaggtaactgggattttaggttaaaaaatgtacattatatatggatagggaagataagagaatgtatggcaaagacattttaaaagttatttcttctagttttcattgagataccatttatttttggctttgtaatttcttaaaatatgagcagatttccaacagcagatgttacctttataattccttcgaagagaaacctccttgtacaatcaagtataaagaaatttccagctagggaaaatagatgttgatatatggaaacatgcaatttatgtaagttggtgcagaagactttgtataaaactatgcccagtataagtcaagttataattaaggtgaaataaatgtgcacatatatgtatagcaatattatatattatatatgccatatttaaactataataaatggagcaataagaaacatttttgtttgtttgtttgtttgttttttgagacgaagtctcgttctgtagcccaggctggagtgcagtggcgtgatctcagctcacggcaacttccggcctcctgggttcaagtggttcttctgcctcagcctccagagtagctgggattacaggcgcgcgccactgcaccgggctaattttttgtatttttagtagagacgggatttcaccatgttggccaggctggtcttgaactcccgacctcaggtaatcagcccgcctcggcctcccaaagtgctaggattacaggcgtgagccactgcgcccagccaagaaacatttttttgcagtgttttgattactaaacatgaagacaaaaattttatgtaatgtggccaaactgtctgagaatcaggagtggcaatctcctaggcaaaccatcatgtacaaacaaccaattttaatataaattcattgtcacatatgaacataaatataaaactctgtgtgtattgaaaggagtaagaggacatgatccaaaaagttatcagtggtcttaatcaattttatgacagcgctttactctttatcagtgcatggttatttctgaatccttggcaaacatcatgtcttaattactaatgaggaagtggttttaaggcttatctctaagagataaatggtaaatacagatataaagataaatacacacacacacacacacacacacacacacatgtccctacatatccaataaagtggtaggaagcaattggagaccacttaatggcatcggaaagtgtcttcaaatggtaaatgaaatcacaagacaaaactcttggaatgggagctacttgggcgcttctcttaagactccagccaaatggctgccaacaagtcaacacataagacttagatctctatcctgaaaatatagaattccttgggagccttacagatggatgagccaggcaaggacatgtggtttggtacttagagataacctcccggccttgagtttgtagcattttctttttctgcttaggcctggattcttgagtcttgaatccagaagcagacaacgtgataacttgggaaaatactggagatgtatgctgagtgagcgagaacacaactgtgaaagctaaacctattggaaatgcagttcttaaaaagagaaggcctcagtttcgtttcaaatggaaaccaaaagcaacagtgcagcagcgtgataagattgtcccaaactgggcaaaagtaaggctgccatgtttcctggcgcctttttcttgctggtgtttttttggacagaaagggcgggagaaggactagggagcggtacttgttggcatatctggagcacgactgccatcgtgaggaaatagttttaaaataccctacgccattacagcgtccgtcccgtgaggtctttcggtttagaaacgcccgttcagcggagagattgaacaggccctgacccgaaattgggcttccctgacttctctgaattattccgggagctctgggcaaagacttgatgctaatatgacaaaggtgatatccaagtgtaaaaacctgttgttggcgaggccggacagagccaacagctgccagaagtccgggcacaggaagttgtcgggtggggcttccgttgaggaaaactttcagggcccagtgcagggcttgtgcccattgtctcctgttcctgcccctgtccctcagaagatggttcaggccaattcaccttgttctggagccatagaacctgagctccttgtgatagcagcatcacagctcataaaataggctaatttgaggagataacttataacagcatttgtgcttgctgggggatctcatacacagcaaaagtctggaccccattgccttagagcaaggagggaaatgaagaagcattgggagccatcccgccgagccaaaaaaggccaaatctcctgcttagagagcagaggcatacactaagaggccaaaaaatgttacacctatagccaaggcctgtcccctaatagagttttgccgtcatctcaggtctcttggtggggttggtggggaagaa

SEQ ID NO: 139035 - DNA, 1016 bp, Homo sapiens
taaggcaatggggtccagacttttgctgtgtatgagatcccccagcaagcacaaatgctgttataagttatctcctcaaattagcctattttatgagctgtgatgctgctatcacaaggagctcaggttctatggctccagaacaaggtgaattggcctgaaccatcttctgagggacaggggcaggaacaggagacaatgggcacaagccctgcactgggccctgaaagttttcctcaacggaagccccacccgacaacttcctgtgcccggacttctggcagctgttggctctgtccggcctcgccaacaacaggtttttacacttggatatcacctttgtcatattagcatcaagtctttgcccagagctcccggaataattcagagaagtcagggaagcccaatttcgggtcagggcctgttcaatctctccgctgaacgggcgtttctaaaccgaaagacctcacgggacggacgctgtaatggcgtagggtattttaaaactatttcctcacgatggcagtcgtgctccagatatgccaacaagtaccgctccctagtccttctcccgccctttctgtccaaaaaaacaccagcaagaaaaaggcgccaggaaacatggcagccttacttttgcccagtttgggacaatcttatcacgctgctgcactgttgcttttggtttccatttgaaacgaaactgaggccttctctttttaagaactgcatttccaataggtttagctttcacagttgtgttctcgctcactcagcatacatctccagtattttcccaagttatcacgttgtctgcttctggattcaagactcaagaatccaggcctaagcagaaaaagaaaatgctacaaactcaaggccgggaggttatctctaagtaccaaaccacatgtccttgcctggctcatccatctgtaaggctcccaaggaattctatattttcaggatagagatctaagtcttatgtgttgacttgttggcagccatttggctgg

SEQ ID NO: 139036 - DNA, 1108 bp, Homo sapiens
cacaaccagaagacctggaagtattttctgaagccaggaggtaacagctaccatggctttgcagcactttttctagggcccagtgtgaaggcctacctatttagagaaacctactcttagctctattaaaggaacagaaatgagttctttagctattggccttcccctaaggaagatgaggccattgagacttgggacctaactgttcattcagattagcaagtattgttctctgtgcctgcttcttagcctttttctaatgaagattccttgtaagccctctaaaagctgagcacatcaggaccctcaggacacttgcccatagcatagcaagaaaaggcaaaaattttgtaagattgactgcatgtgagagttttctcgtgtatcagtgatggattcagtggctgaccacttacagaagagaaaggaatgttattctcatgcactgctgtaacatatggtcaccacctgaattctacttgcccagggtggagctataacatctactaggaagtttttagcaactactacaaagaccatagggtccctggggaaattgactttcctgctattcatgccttggtctagctgtccttgaggatgttataggttgacatgagccaagaagggtttgaaaacatttgagaaagcatgtctcaatggtctcaaataccttatgaaagtgtaaggtgacctctgaccttttcagcctacttcagctaagcaggtgactgagagaaaccctgcatcagatgggttaggctgcctgctgttgagtcacagtttgacttgaccatatgctagactaggaaagccagatgtgtggagacagtgcaccataacttaacttagaattgtgagtgacagagaggtagccccagccctagaattcctcagggtcaggaattttgtattcccacacattttggtttacattaagagactatctggtcagagagtggatagaggcctaaagcagcagcaacttgctgagtcccaggaattcaaacgtgacaccgtgaccaggaatgggagattataactattgccaactctcaataccactcaatcattgacagtcagctcagatcaaaagctgtttcaaaat

SEQ ID NO: 139037 - DNA, 1137 bp, Homo sapiens
tatattggaaagttccattctgttagaggctgagcaggctcggaccatgagctggatcttagttccacctcctgaggcctacctgaagctctggacagagtgaggtccaggtgtaggaactggcccgtggggagggaagactaagtcggcctctggcaggaagtccaggcccaggaagttgtagggtggggtcttggtattctcccagtatgggcgggactggaggaagccaccaaccaacgaagtactgggcctgtgggtattcgtctctctccccgcccctgagagtctgggaaaggctgacacgtggtgccttcaggctctggggcctaggacctttgtggtagcagagtcactgcagagaaccagacaataccaggttgcttataaaaggatgccatgtgcttgctggaggtcccaggtgcaaccaaattgcttgcagctaggaggaccttgaagagaaatgggatcagcccgccaaaccaagaagggttagcacttttgctaggagagctgaccacgcacaaacagatgagaaccaaaaccgagtgaagaggattgaagatgaacccacattttaaaagttcttgtctgctggaggtggcattacctgtgacctcgcttcacttctccatacatggctgttatagcaggtacattgtaaagaagcatgattatttctagaaatgcaaaaacatgtggcaagattttaaaacctgtcattattctaaagaatacttaatgagatttgaagagcattcaagttacaaatgaggaaaacttgttttagcattcaaagtacaagagaatttgaacattttttaagtgtatattatttgtgcaaagtgaagatataagaatgtatggcaaggatatttttaagtggctatttcttgttgtgattgaagtaccgtttactttctacttataatttcttaaaatctaaacggtgccaacagtgggtgtaacttttgtaatttcttgaaatagaaaggtcttctagagtaagatacaaaaaaaatccaagcactcaaatatacattgtcattcatgtatgcaaatggtataaggtggtgttgaagaatttgtgcaaaactgtatccagtttgcattcaattgtctttaaagaaaaggata

SEQ ID NO: 139038 - DNA, 1471 bp, Homo sapiens
tgttttgagaaaggctctcactgtgttgcccaggctggagtgcagtggtgtgatcatggctcactgtagcctcgcccttctaggctcaggtggtcctcccacctcagtgtgctgagtagctgggactacaggcacgtgccaccatgcctggctaattttttgtatttcttttttagtagagatagggtttcaccctgttgcccaggcttgtcttggactcagctgagctcaaatgatccacctgtctcagcctcccaaagtgctgggattataggcatgagccaactgcacctggcctaaatctccttttttttaaaaaaatgatatcttgattaggaaacattcagcaaacattttaggcaatgttcataagggcaagtgaaaaatcttaacacaggcaatcataatagaacagtaatttaatttgaggctcataaaccaactagagaatgacttttatttatatgcattctgcttcttagatgacaggaaactgtatatacatggaagtaatccagaaaaacatttcgtctctagcctgggagaactgatttgatcaatttaaacaggtagctaaatatctctagtttagtacattgttaggctgaagtttttagttgctctctgtgattgtcagggcactttgtattcactgcaagtcactcctggtgttcccacttgaggacttcaaggaagtaagaaatcttcttttaagccttgatatcattagcacattatttgctcattatttcctgtaacactcctcctcatcaatgagtcactgataggcctatatacaggccagtctttgtaaagtgcaaaaagttattttatagctacagcattcatagtatgggctttattaatgtaggaaggcaggtgcaaaacaattcaaccttactcagcttggttcttagttctggaagattcttttaggatacgtgagttgaatccttccaggtcaaatcctgtgagaaatctgcctcctcttccttacatctattatgttttcactctcagtcccagagtcttactgggggtcttagttaggtagttcaaattcaaagaactagattctttaccttggttctttcccacattttgctctctaggtccccattctgcgagaactccaagactaattctaaatccgtcttcaatgttcttgtttctcctggccaccaattcctaatgcccccctccacaagttgacccattttctactaactagatctaaaattttatccttcatcaatgttggctgttatcctcaaaactctgtcatcagtcacatcttaacctattataggccctatcgacaatacatagactatattgggtataaacaatgtttaagaatatgtatacaaagtgtacgggatatgttgcttgtgttttgacaaacattatgtttctaatcttgagtcatccctcgggattccaggataccttcttctgctgtgtataccaa

SEQ ID NO: 139039 - DNA, 1577 bp, Homo sapiens
taaaatattaaatacgccctatttaaaatggctattccataatatattgaaaattggtactgatatggtttgacaattttattggttgcttatttattcatattcaatactcccatggaaaatgagtgacagctctatcttcttttcctaagatttcatatagagtgttttttaagttgcacagtagtatacatgtactagtcacccagtatttacttaatctttaaataattaaaaactagttttttgtttgtcccaaattttgattgtaaagtgtactcagaccagccagtgctacaaaaccatcgtccaagatagcttcttaagggattaaatcaaattatttttatctccttcacccatcattaactaaactctatgatataaaacactactttgaagaacatgttgcttcatgataaaattgtagaaatgtgcagctggcttatgttgattatttgtgttctgaatctatttaaagtaaataaatctgtgtgtatatacatatgtcttgagacatatgtatatacacacagagaaagaaatattctataatcttacaacgttttcataccatgtatttaaatcactttcttaaattgaccaactcatttattttccatttatattacaacatagtatgactgtgtgggtttgtatttttttctaaactaaaatcacgtcaaatataacaggattctgtttcatgtagtcaacataagtcaaggccacatcctctttgtgccatcagggaactgtgttatcagtcaacttacatacttattgtggcccattgttccatttcaggtgacatggaggattttgtgagtcaagttaattgagcaaactgggaaatgggttgttcttacacaggatgtcatccataactaagacctcactgtaagctggaggaaaagtttattacatttgagagaaaattatatgttctttgaaactgtatgcagttgtagtgatttccttgagacatgcaaaaaatgtactaggtattcattttgactaagctcactgtataacttcatttttgaaaacaagagttaaaaaccagacaaacacatcagtatgaccacagtgttttcctttaattttagttcactgggcagattttcttgacaaagttagtctttatgaagagtgctaaaataagcaaacccttcccttctgatctcataatattggaataatcttttataatctttaaatatttttctagttcagtgtaaatcttaaaatgacactcaggcattgaatagaatttgaatcatgcctttatttgctgctgaaaattgcctttagatttctgtgtatgttaaggaaatattgcctcccacccaccatcaccagtatttatgaaaaaaaaaagaattgaatgaagtaaaatatttcagaatcatctgtacggctttgtggccttctccttatttttcactgaaactgtatgtgcttacagccagtttatgtatgctcaatgcctctggaatattcttttattgttaacatttgttttggagttctcttataaaacttgaagaaaatggaggctagaaagtttgttcctt

SEQ ID NO: 139040 - DNA, 1049 bp, Homo sapiens
accttcttaaaacagaaaatttaagtaaagtcttttaaatgaaacctgtaaaagtattgactcttctaccaagttggtatgatattccaggcagctcaatgattatcacatttgagaccctgtgtttgaagcatttacaggcaatgtacagcaacagaggtacctcttggtgtatagtatttacattctcttttaggtagaagaggcaattttacccttatttcacatggttagaaatttaaagcaagatcatttacccaaggataggtgtttggtaatgttgaaggagttagtctggcttcatgttttacatcttcaactaaaatcccatactatctgcttggatttggagagccaaaaaataaagctgattgtcatgtgattaaatatctgatcaacaggtatgaatataacttaaatcagcatatttttgccatggtaataaattgtcctataaactatttatatatttttgttcttcataattatcactaataagcatcagtttgttgtttttaaaaggatatttaagtgagcattttctagttcatatgaaaataaccatagtacaggatgatttctgtccacacaaaggttaaattagattgcacagttaattttcacttatatttatggtactattatgtgggtgatgcctttttcttttaagcccagtacatatattatgcctgcctaagttctgaactggggctgtatttcagtagttgtagaattattgatatttagttttgatagctaatgtttaattgtttggatctgcacagtttggtttttgcacaaaagtcatttaaaaaaatctgagtaattgtcaaatattaaaagaaagatattcttcctgtaaggaatacagtttttagtcaaagtggccattacatcctctttttaatttacataatacagatacttgagaaagttgttgtggtgttgtatgccaagaaaattctttttattggtgcctatattgtaacaattatttttaatgcattgtattttgaagtaacggttcagttaaatttttcacctgctgt

SEQ ID NO: 139041 - DNA, 1046 bp, Homo sapiens
tgattctgaatcagagattcttaaaccagactactatgctttgtatggcaaagaaataaggtcacccatggccagaatccgcctgtcttctggtagtctacagttagatgaagaagatgaagatgcttatttcaacacaccaactgctgaagacaggacttcactaaaaccatgtaattactttttagcttaaaagtgtgaacctatggacatttctgagccagttccatgttaccgacttaggcagaaaataatgaagttgtagaaaccattttcttggttactacatattcattggtattaaggaaatctcattttggatgcctgccttatgaaagatccagctgttgcctcattccttgagtttcactcttccattacctctgaagggactttagaacatgccctctcctcaccagcactgtggcaaggcaaggtgggtatttgtcatctccactgcatacttcctcatagagacattgtgagtgaaggtcaggctcttcaatgctgaagaatggtgacagtatgggttggcatatggaattagcgtctaatggcatttagtgatttagtagattgtgactgtgttgatctttgtgctcttaaacaacactgaacaaatatttcagtctttactatttgtgtggggcccagtagaaatggtcttgtaatatgctaaatacttccatttttataacatataaaagcagagcatggccctcctacagcctcaggaaggaggtggtggcatagatcctctcaagagaatacaggtttagaattaatctaggacttggcagaattctaaacctaggaaattcatgaattaaatcaatttctagagccagacataaaccagatgaaagtatcatgttgttttacttataacttctatattcttatctactatatctagtaaaagagaaacattatcaggtcagtttgtttatctaatatttcctgccagaatttattttttgtcatagcttcttgcatgtatgcaggccaggaaatgaatgttattgtaataaagtgtgatggaaaat

SEQ ID NO: 139042 - DNA, 1132 bp, Homo sapiens
ttccagccccagggtctcattttctcctttagcaacaccaaactgcttgcagtttcattgttcaaaccaggttttctaatctcttctgcctctaacactcttcttctttccgctggctaactccaattcttgcttcacacctcagcttagatgtcccatctgttaggaatcctttctactacgccctcacccatctttatgggttaggtgatctcacattaccccctgcatacatccctccacaaaatcacttagctcaaactgctgtgattaaccatggatgtgcctgtcttctctgccagcctatgtgttccttggtggtaatgcctgtgtcttgttcatctcagtgtccctggagccgaggagagtatgtggcacagagcaggtgctcaataatctgtgttgaattgaagggacagtagaaaggatcacaaaagggtaatggcatacacaaaaaggaaaggaaagggcaggcacatgaaaattaagcccagagtttgggcagataaaaattacaaacaggaaaacaaaagagctcgaaaaatacaataaacaatagagtaaaaagcatactaaaggagagatgaggcgttgacttttaaagtgtttattaaggagaaggttaagactgatgaaacagttctctgtctctgtttttgtgtatggctgttatggctgagacttacctatgaaaatgtggaatcagagggttaaaatgaccaaaaggtaattcatttacttgccacctggagagatgatcagctgatactggtttatctgagagaaaaccaatagttatgtgtgtgattctaaatattgcagatcttgaatattcaaataaatattgcccttgtcaaaatagacccctcagatggtgcaaatgctaatagctaggtgtagcctgttctcacactgctatgaagaaatacccgaggctgggcaatttacatttgtttaaagagctttaatgattcacagttccgcatggctgggaaggcctcaggaaacttacaatcatggcggacgggcacctcttcacagggctacaggagagagaatgagtgcaagcaggggaaatgccaggcacttataaaaccatcagatcttgtgagactcgctcactatcatgaga

SEQ ID NO: 139043 - DNA, 2651 bp, Homo sapiens
aggaaaagtctaacatactgccaattaactcataattaacatgcatttgataacaataccatttccagttaaaatgtgaagagatcaagttcaaagtagaagcagcatttgcaacaacttttatactgtaagatcatttaaaccagtaaggacatttttaatattgcataagtataatacaagtacaaggcataataatattatagaaataagctagaatagctacacacacgcacacacacgcacacacaaagtacattatatccaatgcatcacttctgtgtttctatttttttttaatgacttatcaggacgagggaaaattaactttctactttaactgaagtttgttattcttgttaccacttctctgtgtatatagatctgttgtcagtgttctctttttaaactatgtatttctacatttttatgacatgtttatcttaattgcagataaaactcagaggaaatttgcacagatgctgctttggagaactttacaacctgggttgcagaactgagccttggtaaacctgtctctattacagcatgttgccatacatctatttaagtgcataaggtctttggccttcaagatccatcgaccttaaacaggaatgcttagcacgtttaccatacgtttaaaatccattctttatcaatcagtccttttatagctttctaagttcttattgatggctaatatacaagggttaatttttaatattttaattgatttctttaatcagtttctcgacttgtatttattaaatactcaaactcagtattacctactcaatgccttttaaaagaaagttataatggagaaaaaattgagccttaaacaaatggttacttctgtatattacctcgtaccagtgcttcatcctatttgtaaaatctttctcctttaaaattattggttaatactttgagactttgtttacgtgtggcagtgttgtaaaaagaaactaaagatcacattttacctgtatggatggaatatcccttttcttcaagtgcagtttgtgatgtgttttgtttttttttttttttttttgtaattaacatgttctgaaggttacaattgatatttgaaattgactgtagagcatttagttgaagagttaagcattcagttccattaggttttcacatgtgttaatctcatttacagcattgaattgcggcagtaacattttcctttctgtgaagttctaaatttagttatgacctatttagcaatgcctttgaaaagggatattgtatccatggtaaattaattgtatacctaaacagagatagctcatctttgcctatcaggcttgtaattgacatctagtagacttctgcacatgtaaaattgaattcaaataaaatcatacacactttctagttcttaatatttgtctttctgaataatagtttaaagcaatatttgttaaagttttcttgcactatcacaattgctttttagttatttctcaagaagcatgttcgtattagagacaaaatctgtgtaacaggagggagaatagcgccaagtctctgggctattttttatttttgcaaatgtgctttctaatagccattgccttccatgttgtttacctaatcagcatatttttgtctgaatacttgaacattttaacagtaacgcaggtgtagaatcagaaaggaaacttatgcagagtaatattttggttcagttttaacatcgtgacaatgagggctttttctagcaatgatttttaaattgtgtaagtttgacagtattttattgttgggtttttatttgattttagttgtgtgcttttcatttgcagaagttagtaactgcagctcacctactgcaccaaagttctcgattttaggagcccagctttagtcatttgaacatgcttctaaataaaataaaacaaaaccaaaactatacttttgatctataataagagctcaataactttgtcaaggaaagctctaatatatgcagtgatggtttatgaaagggtgtggcaattttaaatttatattgtgtgtgatgttcaaataaagtggtatctacattcatgtgatttatgggtcagcatgaccattaattactgagtagaaattgactaaactttgatttcctttttttaaatcgtgttgcatttgattcctgagcaaattccctcaaagtgaactcttgttcttaaattttgaattttatggtgagattgtaaagatagaggcaattgaaacattgttccttatttatgaactgcttgaagtgaatacttaatttaagtttgcactttaataccaaacttaaaaccaaacactcatttaaaagtaggttaagtgatcatggatcattgttattagctttgtggctttgtgaaattctaaaggaatcaaataattcatcatgatttaaattttctagagattttgatttttttataatgtttctttcctgtagattgtgttcttgtttctctctctctctctctctctctctctctctctctctctctctctctctctctctcaaaattacagtgttcattgtcattgacctcagcagcaaatttgacttgaattcacttaggatcgcaggaatcaggggaaagtgattttaaaggtggtttctccagcacattttaaga

SEQ ID NO: 139044 - DNA, 1095 bp, Homo sapiens
tggttcatggtttgagacttgagagtggacaggtgcctagttagacctgctctggatgtggaggtgtctggtgattagaatgactctttgtatatctgttccctctttaattgcttccttttaacctcaagattaggcttttattgcataataaaatgcatatgagccattcagttttactccattacctctctggcttagaatgaactatcagtagaattaacaaaaattgcatcatagagttggagaattgccaccaaggaagtgttctagccatactacagaaaagattctccccatgggattacttctcagtagaattctacaattcagaagataatatcagtaagaaaaacttaagtcctgtcagctgttagaaaaacatatccaatcaaaaacatactcccaagtagttttaattagccaatcttagaaacatcaaattcagaaaaagcaatttagagttgaggggagtactaacttatctggtctaattcaaagctagcagctggaattgtatcattgggctcacactgttgtttattatcactggacttggttataatatgtgagatctcagaattgaactaatcatattaatttaaacattcagagattttaggtctagtacataagaaatatagctaatcccatcccttctaccctgggttcactataaacatttagtgagcttgctttccttcatgtgtgattccacctccattcaaggattctatgccataggttccgcttttgctctctgtgtttaatgggtgacagtgaacacgtttaaagatctagtcctcccactccaaccctagtaagcttcatgagtattatgcacattaggatagagaaacaaaacaaaagatatttaacaaaaacataacctgtatcagaggaattccagcctgaggccagatgcagtggctcatacctgtcatcccagcactttgggaagccgaggtggaaggatcacttgaggccaggagttcgagaccagcctgggctatgtaatgagaccccgactctacaaaaaataaaaataaaaaacttagctgggtatggtggtgtgtgcctgtagtactagcggtt

SEQ ID NO: 139045 - DNA, 1520 bp, Homo sapiens
aaggcaaacttttaaaattatgaaatattaccgaaaatggtgatttttataattaagtctataatattgtattaaatcaatacttgcccccacctcccaaaactgatgctactggagaattgctaacgctcttatcttttgtaattcgttgtaactacttggaaaaagtaatacgcatggggaaacaagtagtaaaaacaaacacaggcaaaaaaaaaaaaaatgacttcttcccacccagactccccttgcactgtccttcccaggagttgctcactgttacagtagtttctagtgaatttaagtgtattgtaaggtgtttgattttactggaataaatgcataccattcaatttaaaataaaacatttaagtgtatccatctggttgtaactcttttattctaggcattacaaagtggttttttttcccacttaaaacactttcactcaagccctcttgctacatggctaggaatgcatagatgctgcaatcctgtgctaggataacaggtgttacaaggagtgatgacaagcaggcaggtttagggagatggccaaacatccttatgtacgaatggattaatcatttggaaacttgcttttttaatcagtatagactgggggtgggtaaaagtgattatatgagtcaaggttagtgtgcaacccatgttttatattcttgacaaacccagcaggtagggtctctggaaattatctagttcttacttcagtggacaaaatgatgacgatttctctgtttaggtgtgatttcattttggattcagctttgtatactcactgaggtatgactttttgtaatactgtaatatttctgttatggttatacaaacagcataatgtttttctttctctttgtgattgcttgaataggatatcaagccaatgagagatcaaattgtcagagtgaagagatatgaaaaagtcccactaatcctagtaggaaataaagtggatctggaaccagaaagagaggttatgtcttcagaaggcagagctctggctcaagaatggggctgtcctttcatggagacatcggcaaaaagtaaatcaatggtggatgaactttttgctgagatcgtcaggcaaatgaactattcatccctgccggagaagcaagatcagtgttgtacaacttgtgtcgtccagtaaagaagataacctcaatcatggccataccgagcaggttagtttttgatggaactgtatgaatcaggtagtgttttgttttttgatcaagtaaaacaaaaagctggttagtgttaatacatatggcactgccttaaatttctttatttttaaaataacattttccatcacacaaaatagtcaacattcaatgaagaaaatttttttaaatgcagataagcaaagcggagataagaaattgcttatattcccatcaccaggattttaagtgagttattgttcttccttctctgctttattggtaatatttctttgggttgagttaaaccataatacactttttccctgttct

SEQ ID NO: 139046 - DNA, 1851 bp, Homo sapiens
taaatacagtatttacttttgtaattgaagcatgattccacaaccagctgtggcattttatttcacttttctagatcagaggctttaatttgtagttaatcatgatgtggaaagtcatcttctctctactccatcaatttttttcatccgtttttgaacatgctgaagcactttgatcttgccataagtgttgtcctataccactaggtggtgttcactaatgggagggcctcagctcaccggctctccaatttgggaaaaagcaagtacctcctccctaccatcagcagaaactgaatgaaattaatctttgcaacttgaatctgttttaagtagcattaccaataagcatagtggtatctgaataaggaatgacatttacattacattttattaaataagagagaaagttaatgtgctacttgaaatgttatttggttctttgtccccctcattgcagagtatagataaggatgctcttaggtaaaatgcagccacaagttttccgagttcctttagtctgtagggtaggctatgaggtacagaatgattagaaactgaaatcctcattatttttctctcaaatacatttcacatacattgaaacagaaataggcaaaatttatgagggaaatctgatttcccaattctgatgaatagatatactaagacagtagccttgtttaaccagtgcctgtagaaggcactagaataaatagcatgtccaagagtataacaactttttttgtaaatttagttactagcctaatcaaactgtaaatataactcactaattggtaccatattttcatttttcttattgttcatctttaaggtttcattttattgcttttttgtagctctaagtaactaatcaatttaatttcaaaggaaagttaaagaaagtttaagcttttactgcatggattctgcccgcctagctaggttctgaactgacactgaagtatgacaagatacagattatagtccaaaactatcctttacagttcacaatttaagaacaaatttaactttatatacaaataataattgttatctaattatatttagttgttgctttggcaacaaaattacaacatggctacctttagacatttgtgtatgtgaacattttacttgtaaactataggtgatttgtgacagtatgagcctgtagaaaatacagctcaaaactatgaaaacagacatggttgagttcttttttaatcccaaaggcccatatataaaagctgaatttgtgtccttgtgtgactttttgtgaaaaagtttataacacatggattctagaatcaggctttatagtttatagaatttgttgtgtggatagggttattccacagtatttagacttcaaaacgcaatcattgcatttttaatacattacctaactttttttataacttaattcaaaattaccccattcaagtggcatagctgtagctgcaaaaattctgttttctggaattacatgagcaaatatagctatatgaggattaatgtatgactaaagcctcttttgaaattaattcatatttttaaaactatacataaagatactgtggaatgaccccttaacagtgtttaagaaacatatgctgcagttaattgactgtctcagttagggtgcggatgtgtgagacacaccttttttgcacttatgtacatagtccatgaaagcaatccttggagctttttttaaatgtaagaagtctgtgataatagtggaaaagttagtaagagagagttatttctaaggctttgaaaaggagggtgtttttgctctaagacttaactaaagcataatgttgctttgctgttacggaggctttc

SEQ ID NO: 139047 - DNA, 1004 bp, Homo sapiens
ggttctttcatgatcattctcaaaagccccatttcaatctgaaattcagattggggatattttggcactgttaacagacagaactggaacaagacccaccacactctcctgactcttccttcaataacctttcaatatttctcactctttctttctttctttttttttccatttcagctgaaattctgaacagcagagttatggagtatcagaatctttccatggaaacctccatatggcctttctatatatattctcgtatgtcttattctaccaacacaacaataagcgtgttgcagtcaatgtattaagcaaagcaaacctgccagccagcaaattcaaataaaaaataaagcattaaaaatcaatggagatgttaaaacaacacaaatagaaaactagtaactaccatccatcctatttgaattatcaagcagaacatgaccataaaatttggtaacttgttacattactctttgtgattttctaataaccatgctaagtgtatttccacagtgagcttttggcttactatatacattcttggtggataaattgttcatctgtttttgaagtgttaccttactattttgtttacaagatagtctattgggttgattcaggatgtaacaaatatattcagtaccatttcttgtgttgtattgtgttgtgctgtgttaggtttttacatactgtagtgttttgctgtatatgtgtggtgtttgatttcaactaaagtgttattagtggggaacagaagtatatgtgcttaagaacatgacaggttcatgcaaatatgctctctttctttagaatatttctgtaggtttcttgggactgacatttaaaacgcctcacttttgaatgtgcacaaaacctgctcattaacatgcatgtgtataatttgtacctgcagatctgatgttgcataatacaatcaaattactagattttttaaagagagaaataattacctgcacaaagcagagaacttcataaaacat

SEQ ID NO: 139048 - DNA, 1329 bp, Homo sapiens
tgttctgattcctggaaacccacctcttgcaatgccaggagctgttggcccaaaactgatgcgttcagataaactggaggtatttgtgaacatatatataaatacctgtagaatagatattaaccttacacataaagcagtattctcagagcccagtgtgttgttttaaataagagaacccaaatttcttagcttatagggttgttaaacattttagtactgcaatcataccttgttataaagtgcattgattcacctgtatggtaggtcaaacaatatgttaagtgtacccagccatagactgtgcgatggcacaggaagcctctgtgggaatgttccttttacctaggctccagctttcagaaacagattactatatttgttaatgagtctctacttgctagaataatcaaagtgggaaaaaagtagacaatataactctctacgattgcagaatgtaaagctatatgaacacagaaggtaaattagtctcatagtgcctcaacttttttctccattttgagagtgatgtgctaggcagtaaataaccccgatgcctaagaaaagaaaatctgaaagaaatttcaaacagctttttgatttattgaagtccttcattcttctattgttattctttgtacattgaaataactagtctttccttacaaagtcagctccatttgcagccgcttaaatgcctagtaatgtattgtaatataatctgattgtacatataactcagttatggttcacaagttgactttggaaaaccagtgcattatggtgtgataaagactcatcttggacttaaaaaaacactaattatgcttaaggctgtgtattaactggagaattaaaactggttttcagtaatacttttttaaacatttttatttcaatgtaaggacaacctccttttggggagaatagaatttttttctgggaatagaaattctgtctgtttatatctcatagtgaatatggctttacattattctttatctttttagatttgttcacacataatatattcaatgtatatataattactgttacattcactagcaaaataaataaaagccagtcagcttccagtcatcagtgtgatgcgtgtgtatgtgcatgtgtgtgttctaaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagact

SEQ ID NO: 139049 - DNA, 1072 bp, Homo sapiens
acttggagcatataacaaacctaagaaagtttaaaagtattccaaagaaagcagaacttagctaggagaatttccctggtgagtcacctcaaaaaagaaaagaaaaaaattacagaagtaaaaagctaccataaacagaaagcattgctttcaaatacattaggcttcaatattgttgattgatcagcatttattagtgattaataactttttaatctggaaaattcacccacctccaggtctttctttcagttcaaaaattaatagatacaataatggtcctgctcatttttgtaaaaggcaagagcaaaaagtatgcaggagaatgggctggtggcttcagtgagaaatttaccaggaaagtcagagacaacgaaaagtcaagtgaagagcactatcgtgtgcttcaaaaatggactctttctcatcagagattcttggtgatcttgagacaactatgaatcattacattgataaagtctgccttattgcggaagcatgcctgggtggctgtttccagaagatttccttctcattatataaaatcatgtcacatcagctagttcctgagcttcacatctcattccatgacaagtatcccgtattcctgtagtctattacatcataagagctagttagactgggtcagcccttggctatttgcccccagactttagagtccttctcctgactacaccatcatctttcctggcacctggcgttccctttccacttaaggctcttggcaaccatgtctttcctactcaccctcgtgagtcttgccagttttttggtgccagattctttctgcccttcctaatgtcccaatcagctaatttgataaactcatctaaggtagaatgctaatgggggagtgcttccttctaagctgaatatggtttataacagagtcttcttggaatgctgtgtgggtgacaatttcaagtctgtgtgggggtgaggcaatgagtatacattgcccttcactttatattccacaatttgtatttagacttgtttctattaatgtgacttagcaggtatgggcacagtttggcaaatgcaacagatt

SEQ ID NO: 139050 - DNA, 1053 bp, Homo sapiens
gtctgcttacactcattatatatgttgaaattgcgtagctattcctaggctacttttaagaatttaggaggattaggttaacgtgattcttaactcatactaccaataaattattctttctccaaggtttgcatagaaatataaaagtacataaaactaagatagtatttgattttgtaaatcactttaatttaattaaatgtaaattgagcaatgggaaaaacaaaaagacaaactcgacagaaaacaatgatgtgtcttttaatttctcacactgactttaaagttatactcagcttcttgccagaggaggtaaaacaatagagccaccttgccctagtgatctaatatttaaaaagagccgttgcaatgcatctgggtttgcattatatgtagctctagaaaagttttgaaggacacatcttgattctcagtgaaattataggaatattttaataacaacataactaaacaatggagaagccattgcataaactgtgtaggcatcataaataaggaaaatgcagatagcatgtgttgaatgaaaacacttggtgaacaaactcatttttctctcgggaattcaggtggcctagcagcttgcactctttggtccaaaaacaaagttgcccttttgctccccaccttccccttccccaataacctcacctactgtaaagaatcttagcatctgtggaaaatagaattgtttgcagttgtgctttcttaaaaggtttatggtggacctagtaatccaaataagagagaatcgttagcttctttatatactgctcatgagttcaacacagtaataggtcacattgtgacaatgtgaccaacaactagtccagtgacatcctttgctgctacatagtaaaccataatcagcagccatgccaacatttaggtgacaccaaaagcatgtttgattccacggaactgacatactgtcctgtcttgaaagtgcttaacatcaataaaaaacattcaattagctgaggatccaaaatacactttggtttccatcatgcaagtgatctagggccattgtct

SEQ ID NO: 139051 - DNA, 1110 bp, Homo sapiens
aaaattgttgccatttacagttgggtaaactggtgatccgttgagggagagtgacttgacctagttcacatatgcagttatcaaaagagcttgatgactccggcgttcttccaatcattattcagtcttctttcctgtggagaagaaggaaatggagagaacatcaattaggctattgctttagtaaaccaaaagcatccagctcttatcacagtcatgctgctccacatgacattgggactgtctgtgaagttttctggttctcctttactttttgcactataaagtaaggcgtggataagccaacttttcctttgctaatccctccctcttttattgtttctgattcatgataatttagattaagactttattaaccttcatatttagttcatggacaattatttggataacttgttttgaaaataaggcagaagagaagaatttttagacaaagttacctaactttgtgatactaaactttgcttaattgctgagtgtcagaacactgagctgtctctgctcccttgtccatccttctccccaaacaccgcattgttgagtttgctgaccagaactggggattgtaactgtggctgtgtatcacatcttcactgcatgaaactcattgatgtctgattctgttatatactcattagtacaatgccctggccagctaggaagaaacctgtcatagatcagctgaaatattgcagtagcaattcagccttattatgggtcaagtattttatacaataatttggaatctaatccaacttatttaaagtgttgttttatgggatcatagctcaaaatcatctcttcctggccaagttgtaattgggcatctggtgagaaaagacttgggctagggccaggcatgtattccccaactactgtttgatgttaccattaatactgaccctttgctacaggaactccattaagtaggagagatttggaaattggaaatttgaaaactattatatttcaactcttttgtctagaagaaactcttagatgttagggtaatatacatctgatcctacttggttagtaaataatctcttcatgtagcatagctgaaatgaagtctttttctctatatca

SEQ ID NO: 139052 - DNA, 1070 bp, Homo sapiens
gaagcactctacctttatttattttgattatataaaacttttgcctgtttaattaattgacattgctactgtctgggtaagttttactatagtctctaaggatgctgttacatcagctctgttttctatcccttgggcaactgttaacttttttccgtctaggtcccttgcactctcccacactttatttaaagcttcaccttggctgaagtcaaacctaaaacaccaaataaatactataattggctcatttttaacattttctttgaattcctaacagcccatttaccatatctgtcattaactgggatcttggctttattgagtgcctacctcacaccaagcatttgcacatctgtcatatgacttattcctgctaggaaactgagatactgagtttaaatatctggacagaggttcaaattcaggtctttgtgattctaaaccttattctgtagtgtatacaacaacacactttcttcacttctctgggtctggtcttagtttcctcacctgcaaaagggaaaaaaatatataaaaagtagactgagagcctattaagtgttaggcaccaggctaggttctgctctgaaggggttcacagaaatagacaactttaatttaatgggttcatggtggtgatgtctgtttgaacagtgttttgagtacccattgatcccttttacttggtgtaaatcaaaagctggctctcgcagaataagtaggatttctcccattctaaggaagcacattccataatcctataagacctttaaatatatttttaaaaatcaaatttatgttgtactcttctttctatacacaggtttattaagtatgtggcatggaaattatagtttgttagactattaaagttcatgagaacaggaaccatgtccactgccttgtactaatacttaatacatatttggaaaacaaatgaaagaaaaaatagttttaaatatggagactcttacacaactgacaatttgaagttttaatgagtaactactatatagtgcacactacctttattatttatacaaatttcaactcaactagtatttatt

SEQ ID NO: 139053 - DNA, 1047 bp, Homo sapiens
ctccttagcatataaaatgtatttggatagtcaatacaataagacttttgtgtggttacatctttagttgatacagcaccattccacttaccactaatggtcttgctgatttttctattggcccgaataagctcgtaaagaaatggcatatggaattaatgtttttttggtgttttaagtttcacttctgagttcccacctagatgtgaaaaccaagagccccttcattctttactgttattttatcaacctttgcaattgtgaggagaagatattcttgattttaacttagcatcatatttatttacattgtatgatcatattatttcttttcactgagggctactgatacattttctcaggtgcattgaaatattaattaagtagaacccaactgtctgaaacccacagtcgacagaagttttatttgtatttgattattaggaaaaatttgaatttaccaaggattcagtgttaagaaaagtataaccacgttctttagtaatgagagaaagttttaattccgtttacgatatgctgtttaccaagacaaaaacaaggacttgtattttgaaatggtttctatcaaaagtggtttttagtaaccatgattaaaaaattaattccgtattttcattaaatgaatctatttcacatttctactgatttccaacaatattgtgctttatcttttcataaaacagaggaagaaaatctatttttctcatacatccattttttatgttcataatctcatgccacattattctcccctaaccccttaaaaattgcagacaaattttttagggacagtgatggcttaaccttttttaactttggcacatatacagatcatgtttgtttgatagattataaatgagaaatttatttatttctaaatcttacacagtgataggaattgctatgcaattgattgagttctaataatctgtatatcttaaataccacagaatgagaaaaagcagtcattgaaaaggcgtggttttagtaatttcttaacattttatgggatacttttttttaaaa

SEQ ID NO: 139054 - DNA, 1539 bp, Homo sapiens
ttcctaacattttgtttggagaactccttataccgcattcctcattttcatgaaatccaaaagaaggttgaaatgctgtattgctgttagcagagttttccctaaactagtaagtgagggaaaccccttcttcccaagaattgcaaccattagcactctcaggaagcctgcaatgatttggacataaggaaaacaaaatatatacaccttctatgtactcacaacattttttaaaaaataaaaataaatataatcatgttgaaaaaaaaacacttgatcatctcagatccaggagaggagctctggctcatattattcctcatgttggataatcattaaaacagaagaaaataaaaccctcttgaaatggcaggttttttaagtgaaaataagtaaggtttccttggacccctataaggagactcttgtgaagcatgcatccagacttctgagactttatactttttgctttctagagcaggaaagacttaagaaataggaagtcagaaagtacagtaaaaatctatgggttctgtgctgttaagggtccctttctgattggcttggtgtgaataatggtatagaatttaaccatgtaagatgttagaggcctgagacttcccttgacatttccttatgctggcaggcccaggcagtttgactttggctcttgtggcacttgggtggcaggagaaacagtgtttacaaccaccttcacctccaggaatgtattatacttttaaatcaatcttagtatctgtaggcaggagtttatatataggaataaaatttgaacccccattttcacacccaataaaaacgtcctgtaataggtgtttattcagagtcaactgacatttattgaacaattactgtgtgccagatgctctgctaggtactttcattttgttatgacagtttttttaagttatgaaatacagttggttctagctgggcaaatactctctttggcatctaatagatatcaggctaaaaattgcatcctcaagtccctgctcactttttgtataaaacacaccccccaacacacaatcatttcttctctgtcttgcttcatcatttgggaaccatctaatggcccatggcctgcctcttccatccatgaagatatttatttcattataaatcaagccaacactaatctgttacccatcttgatgtaacaaaaggctgctttcactgtttgatggatggtgctacagtaggataggagaaacaggaagaggcttgagaggtggatgaagagtgaggggtcaggagtgtgaaatgatgtggagttaagtgctagtgaaagccatgtagaaaaatctagaacaaaattggattaaacttgtccagaatgcagagaaaataacaaggcaagatgttggaagttaatccctcacccctaggagtggccaggacagcccaagttgagcaacacaggaggatttttttttgttatagaagcaaagggcaaagaaagtctctaaaaggagggagcaatcaacaaataccacaggaattatgtaagttgag

SEQ ID NO: 139055 - DNA, 1077 bp, Homo sapiens
agatggttccatgacattctgttcttcctaaatggttatctattgcctcaagatagccaaatgacagtgttggaaaggcaactttgagaattaggataaataaggtatcagttgtcttaatggatgttaataacatccacatgacctgaaagggataagaaaatattttttcagatcattgtagtaaaaatgcattattaactcatcatttagatctgcttggtattagattgagtgacattgtttttaaaagattgatggagaaaacaatacaatctgggaagtaggaccttatcatttttatttgagaaataatgggacttccaaattgcctgggcacacaaacacacacgtacatgagtgtacaaattagtggtcaattcaaaacaatgtatacagatgtgcattgctttctcactggaagattataggaaaatatttttacagtattcctccaattctaagaatgaaataaaaaagttcactgtaaactattataaatatttgatatagtgatgtcactctgaggctcaggaaaagaaccagggctttgaatgttcaactccaggcagttaactttcagaaaaaaataaaaaataaaaagatgctttgctcagaactcaagaggaagcaagaataaaaggaggcttgatttaaatgtgtgtgtgtgtgtgtgtgtgtgtgcgcgtgtgtattctccctttgtatgtgtatggtgattttcaggaagcccaagcataggactcagtttgacatgcttcctaaaatattatgtcaactctcaagttttacttgcatcagtattaagttggctcatgaggaaaaggaattatttgttttctgatttgaggcaggagtttgttttttgcccagacagtgagtgaacttgaagggcttagaaataaagggcctcccatagagaaaaggcaacctggacagaaatgcagggggttggcagtagagactagaggtcatttgatctctttaagccatgggagcatcctggagtctgatagttggctggattttgttttccatttaggatcacaaattagcttaaaattgtccacattggat

SEQ ID NO: 139056 - DNA, 1011 bp, Homo sapiens
cttgcagaaccttgtctcttcctgccctgagtcaacacgtttgggcagctcgcttttactactggggtttgaagggcatgagagtagattttaggagactattaaaaagggaactttagtttttaacactcacacaataagcttttatggtaagaaaacgaaattaaacccagacgagtaatgaaagttgacatttaagtgattctttgttgtggtttcataattagggtaatagacctactgtgtgtttttctgagcactcttagatagctagctagctagctagctagctagatgatagataaaacagataaattaattgtggctctaattaaagtaatatgttttaaaggagttattttctcctagatgttcttacatcgtttgtaaattgagctgggatccccacagcctctccgtatttgtgggtagacttcatgggaaagaatcaattaaaacaaaacttgcaagatttaattttgaagtgattggtactttttttattaagcggactccctgctttagtgaataaacgtttgggtgattactgatataatgtttggaaaacagattgttggtatgtgggaatgactaaacatccatgcttgatacaatttatctgaattttgttttgttttgtttccccctccagtgaaaggtaaatagacaatgaggcttatcagacaccttggatttttcctgattatatttccatcttctccttggcccatgaaaatctaatcctgaatgtttaactactttttaaaataatttttaacttttttctaatgtgcgatacttttgggggatgctttcatatttaccaacacttcttcaaatatagactaaaatgggcttctgcccacagctcagctgataatattctatcgctgttcactccttctcccaaagcagtagaaactacttggttggcagacgctctgctactaaatttagcaagtgtgtggaaagggagaaaaatattgttttgcccttattaaagcatggtgc

SEQ ID NO: 139057 - DNA, 2023 bp, Homo sapiens
caactaaaatgaaacataaaaccttttattttcttctgattttaacaaggaatctatttaaatagaataacaactgatggtgaatcttaccgagctgtagaaaataaaaaattcctctccaaacatgggtagttttatgtcaaaatattggcttttcaagaacaggactcatatcttgatatttaagagatgtttaaaattttaaactttttctaccttctactgtttaaaggttttacacagggtgtatctcacattaaacaaaacacctttttttcaaaatgaaataccaatgtaaagatctaatttccaggcgctttcagggcactgtaatttcaacaatactggaatcattttggcgctgcttctcattcattttaaggcttctctgaattgtgctcattccaaattaacccatgtatagaatctttcttcatcatctaaatggtgtgttgctgaagttattgtggtatataatcctggattaaagtcaggactttctttctatagaattattttatcaatatttgtgtagtgaggtcctaatcaagaaacttgaacaggataatgtgtctaaaaatattgctgaagttattcttgatcagatagaatttaacctaaaatgtgaactcttacttactttttgtacatctctattgtaatgtttccagttgggccaactatttctagccctttagttctttttcatgttgacagatttgtagacaattacaaaagccaaaaaaggataaaataagcattaggaaggctagccagttattcaatagcaccttgataatgtgggcaaacccttctacaaagtttttgttttgaaaagagcaaaagtaaaaagtgttctgtagtgaggttacatatcaggaacatatgagttgagcagagtaatttggtagtgtaagtcgatgcaaaaatacttctatggtacctattacaagctgaccaagataaaaagaagtatgtaacccactgtgctgtcaagcatcatgattccgggcagttttcattttactgtggattttgctatacttatgcaaggacttacactaacctcctggctgtaaatcaaacaaggtgactgaaagtggcatttatgttttcacaagggacatgcttagaagtgtgaccataaagtcacatcttgtacaatctgctcatgtgtttcatctgtagtaatatagccacaaactggacaagaagctgggtatttgggtttaaaatagattttcttgactctgagcttgtatcagtatttctagcttttgttttgtctgacagtattgcagtcttgaaaatcctgagagctaaaaaactgaaaggaatttttccacaccttgaagtcacagtgttttagagtaaaactattttgtgtacaattgtgtttttaaaatagttagtagatcactatggtatttcaattttctttagttttaattgaaaatgtttgcttttaaaactgataggtattgttggaaagcaggatgaagcctgagccagtggaaaagcttgttacagaaaaaacattttgtgttattgctgtggtgtgcatgatttgcaaagattaagtgcattttctctgtctatactgattattgtatatagaggatgttataaatatacatatacatttttgccattatgtaaatcccatgatttcaactgtaaacatctgtccattggtgtagctttacaaaccattcactgattttgtgtaatttaacaatagatatgaaataaagtttaaattacaggctctgagtaatctcataatttcaagatttgcagctgctagacattgtgatctcacaaaccagaacagaatttttttcaacaagacatttccttttatcctcttggcagccaggtatgaaaattagatggcccattctaatccctcacactaaaatggccttaatttggggtgattccttctgggagtccatgttttttgtacaagcgtgtccaacccacaatggtgctcttcattctcccttctatccacagggta

SEQ ID NO: 139058 - DNA, 1050 bp, Homo sapiens
gaaatgtcaactgtcttctttcttgttaactttccctttgtttgcttatctctccagcaaagttctggctgtggctccttgaggaagagtgggagtacttctttatcttccacagagcctaccaaagtacaaaatgagctctcagtgtatgcgctgatgtgagtaaagtatctgcagtatctgtagtaaagtacctgcaaagtatctgcagtaaacagaataggtatacaacacatgccagaaaagaccacctattctcttattccatcttatagcatctcataaaaagtgcatgcactgcaactcgatatgtgaaaaagttctaaaaaaaatggatacataaagaagtattcttcctccttgaactttaaagattcttgagcttattttaaacaaagagcattttgttgaggattttggtattgagccaactatagtacacattgcatttccctgaacctcatgatgttacagagaggggctaggagcacttctggggtacacttaccctacaggcacttctatttgaacctactgcttgtccctgcctttctgaatctgagaaattatacctgagagtactttttaaaaaccagttgattgaagtatgattgacatataaaaagctgcatacatttaatatttatttatatttaatgtatatatctcattgagttttggaggtaaatatacatctatgaaatcatcaccatcattaaggacataaatatatctatcatgccctaaaggtttcctcctgccccatgattattattgttttgttttttgataagaacacttacaacataagatctaccctgttagcaaattttacatataaaatcaagtattgttagccataggcactatgctgtgtagtagattcccagaacttatttatcttgtgtaattgaaagtttgtaccctttaaccatcaccacccccttgcccagcccctggtagctaccattctcctttctgcttctatgagtttgacctgattgtgcttttgatggatgttagaactatcttccttgacctggcttcagc

SEQ ID NO: 139059 - DNA, 1066 bp, Homo sapiens
tgcattttcatgtttgacttcagctgtttctatgtccattgctggcaccagagtcctgcatattatatcgtgattatgttttttcctctaattgagacccatgtattttttctaagacattgggttgtgactgttgctaacccccactaattttgccactgtgtgtgtatgaaagtatgtgtgtgtatgaaagtatgtgtgtgtgagtgttctcttcaaaatggttgtatgttgcatgaagatagcaatccactggccaagtatttgactttgccagtaattgctgtagttttatgtgatgataatgtcaatagttccttagtttagctactagactaagtctaatatcacaaaagcttgtgacaaatgaaagcattaatattactgcttattttttcttttactttcttttttcttttttgcaattgcacctttgtagaaaaagacgaatgacaaaagcataaactgatgtcagaatgtattcctaaagatggcttttagtggagtgtgctcaaggatgaattcatttatagcctaactaccttttccttcagtagtcccccatccagaatagtgtgagatctttgatcacaacaaaaaattccagtttatcccagaaagtgcatttattaataaggcaggaaagtagcctaagctatttgaaaaggactttcaataaccggggataaataacataggctggacatgctttgatatttaacctagtgctagtcagctgtggcaaagggctgtttaaagatatctttaaataaattaggcagccttttgtgtatttgaaagaacatcagctttggagttaaatagacctgtatttgagtcctgactctatcattcattaactttgtacctacctcattgggctgttggtgaggattaaatgtcataaactaagtaaggctctcatagtgcctggctcgtgacaagccctcaataaatgtcaactagtgattatgcttgtttcagctgccaacgtattgcagtgggggacagtgtgacctggccagtatgattctgatgagctctgtttggctcagtttttctggtt

SEQ ID NO: 139060 - DNA, 1072 bp, Homo sapiens
tgagtcaggtgtgttttaagccacagggttcttctcccacaattagctttgaccaaacagcaaaactcagattggagtgggtctgattgccattttggtttaagtacactggataccatttcagcatcaaatcattcaatcagaaacactgaaaatgctgaagagttgggttagttgcaattttcccacctgaatagaatgtgcataatactgcaaattgttttttcacttttgtagtgctggagacatttatggaacctgtgggaaagggttttcttgacagatggagatggacagccaaccagacagaaggagagctagcactcattaacttttcccaacagaaactcacctgtaattgttttcacaggcctttaatgaggcttggttgtgaggcactagagagaggaaagcagcttatccatagaaaaggatagctactcaggtgaggtagaggaagcctggatccatagccttggaaattgtaggacataaggtttgagattacaattcaaagacaagatgaaagtgatgagggctgacaagtagtctagagatgggcaaatcaaaagaataactactggggtagatctgtttcggttatgtaagttaggaactctaaatcaaggagcacccacccccccccaccaatctcatatatccaaaattatatctatgtgtctttgaaacaggttggatttattcttgtaaatccctgggattgcgggatgtttcagtgaccagagttcttggcaggatcttaatctttaggtctttgccccaaagatctttgaagttcccagacagtctgcagctgcagtattttctctttatttttcatgggacccttctagaaactgcagtgtccttgatatcactgctttagatctccttctctctcaaagtttcagaattatggcatcttgcccaggcttatctaactgacctggattttggtggaggaatgaagactttttctgtcaatgttaggtaaacttttctataccacagtcattagtacatctacaaaattaagctccgaggatccaagccagccacaagttcttcttga

SEQ ID NO: 139061 - DNA, 1024 bp, Homo sapiens
tgctcaggctggtctcaaactcctggcctcaattgatcctcctgccttggcctcccgaattgctgggataataggcatgagccaccatgcccagcccttaaattctgattatatcagagccaagactttcttgacgttttgaagccaagttgagagcaaaacgacccatttctgattttctacataataaaggaaacaaaccaggaacaataatcaaaggtggattttttgtttctttgggaagttataaccatatttgcataaactttaaaacagttatgacatctagttgaggtactaaaacagtttctttttttaattaacttttgttgcaataaataaggccagactaacaaaaatatatccaaagccaataattctatatttgtttggcacatgttgcttccttcagcatacttcaggtcatctttgccaggaattgagaacaggttgcatgtaattacaaaggctccttggtgggatgaaggacaggatgactgacgaaataccacagctaatcagataagtgcaccagggaaaaagcaacatgtaatggctggaaacccaaaacacaagactttttttttttttttaagacagagttttgctcttgttgcccaggctggaatgcaatggcgcgatctgatcttggctcactgcaacctctgcctcccaggtttaagtgattatcctgcctcagccttcccaagtagctgggaatacaggcacccaccaccatgcccagctaatttttttatatttttagtagagacagggttttcaccatgttggccaggctggtcttgaactcctgacctcaggtgatccaccgactcagcctcccaaagtgctaggattacaggtgtgagccaccatgcccagccatcagcaaatgagtctattatgatgggaatactcatgcccccagactagatctagtttctcctttgatcccaagccttctggtgttgttctcctttgagcccactgtcccttctctggcctgtcctccttaatcttcttc

SEQ ID NO: 139062 - DNA, 1752 bp, Homo sapiens
tatgcttttaaataacattatatttaatggacctttgaaagcactgacatatgaatccattttctcacctgtcagcagaactgttttcattaaagaagtcagtgaaagaccacatgctgagaggagctaaaagttggtggcagggaacatttcagcttggtatcttgtcctttcacctatatctactgtgaaaattaatgaacagttatctaggaatactaatattaggattgatttctaatcaaagggaaaatgatgtcaaagcactatagtgaataaaggaatgcaatggatttatttttaacaaacatagcagaactgacataatggaaaagggtgctgatttcttcaacatattcaacatttgcatgttgctgtattggttagtacatttgacagctgtagcatgttctcttgactctgcttggttgagagatatctttgtcctttgagagtggattgaattttgggaatcagtcaaatgtcctgagaaggtaatgatgatgtactaattggatgatcagactgggtcctatggttgggggccagaagtgaggtgtgactacacagtcatgagtgatatttctcatgtggctcataactgtctatgaagatagttcccagggaacagctctggaaatgtgaacgccagcagtatccttggaatctgtatacagcttctctgggtaacaactttgagaggaccagcatgcattgggtacaacacaggccctcgtgcgcttgctaaagatctgcttcaatactttgtcacaccgcctacactggctccacatttgccaagtaactatgagcatggttctccttccaacaatctggatggagctagcatccttcatgagtgtaaatttacaaaagtttaattaatatatcttgcttgctaatgagttattccttttgactccatagacatgcagggccaaatacatgatgtcagaattccctgagtgaattattgagcttgtgacaacctgggtcagaatgaaaaatcaccttagtatatttaatccagaagcaaataaagggccagagaattaattaatatgggttttaatttgttaaggtcttaagagggagcctctgtttgctctggtacctttttgtgtgtgtcctctttgattacaggtgaacatgcctttgggaaaagatatctacttctttactgtgctcctcggtaacctatagacaagaaagaaaaaagtgggttcttagtcttcagagagcatcaaatcattgaatttattgtttaggtgatgagccaatgccctgttcccaggaataggtttcatgaggaattgctaggaggcatagaaaaagaattgcacatagtggaagtagatgatgataaaagaaaacaagtgctagagctggacaacagagcaacaccccatgagtcctgaacaaagaactagaaagaaacccaaggaaaatcagagtgcttctttgcagcctttggctaagtctccctagctcccaaaaggatgtagacagcagataacactgctgatgagagggcaggatccagacaggtgagctgtgctagggaaggggctgccaaggaaagccccaaatgcaatggtacaaggtgatccagtgggagcaatccttcctattgtcccatgagcaggtgctttagggagccactggtccaaggcctgcattcaaattcatgcctcctggtttttcaccatctttccaggatcaggttagatcacagaaaggccgcccatttgc

SEQ ID NO: 139063 - DNA, 1044 bp, Homo sapiens
gatcgttctagacatgtccccattaaaggatatctaatagagatggttttgtaaaatgagaagaagccaatgatagccatttaattacatctttagtgtgacgttagctccctgtcttgagaagcattgatattctccatgggtgtttacttgagcaactactctgccaggcactgggagtacagaggtgaattagagagagatcctgtctttatggagctcacattgaatttgggagatagaactaaccgttgtggtagaatatggttcatactaatatgtataaacgtagatacttggtacttcaaggagtctgctctaggttgagtcgttgggtcagaaactactaagggaactattctatggtttgctaaagctagtgatggggcaggtatgttcatttcttcacctcatataaatatctttggactcttggcatgattcacatgcatacactttcaatctatctgccagttttaaaggcaggtataatggtgaggtctagtttcaaaataagtagcttttataggtaatattctgtggtttcttcttgaatgtagaaccagaccgattcagaataactctcatgtgacctgttgtgaagagccggccttaatttttctttctctttttttctttttgcaacaccagctccatttctagtagcaaatctgagccaaaagcacagattcattgactgtttgcataagacactaaatagacactgaacagaggattaatgtagccctgtcttctgggagcttatagtctaaaacagacaacaaactggaaagaatatccaacacacctgatatgctcatttcccttctcatataaatccaaagaaaacagaaagtggcaagtcacattctacaggattgggaaaatcccctagagagtattttctttttgtgacttttcaagttaaaaggtattttgtatatgacatgtaatagattacagtgttatttgatgaaaatgcaagcaatgttcttcctttcttttttactatcaacaagttacattggaaggtgtggatcaaat

SEQ ID NO: 139064 - DNA, 1695 bp, Homo sapiens
aggagtacagatggtgagatgggaaagaaacggttttggtaaatatcaatggggccctttttgaattttggtgagctgaatgatgtatgaaaactatttgcaaggctagcatatttttcaaccactagtaaagcaataaaacaaataacatttttggtaatccccattgtatatgcagtttcataaatatacaagattatgattatcgctgcctcataattaacaatttgcataagtacttgctattttttagttgtctgaatagatttttgtaatccagagaaagaagggaacaatcagtggaagccatcccaaatgcctagtattattgctacacacttgcacaattaacagcgatactaattgcttcagaccagaacctcatttgtttttctaaggacagcaaaaacattaatagccagagtgcctgtcaatctctctctctttttcctatagccaactgtatcatagggtctgcagttgactgtaagcaaattattttgttggattttcagtgtatcatcttgtaatggagtttccaagtttcagttagcaatcaatgccttgaacagccagacttatttttataatattttaacaatagacctctataaagttaatgaataaaaggatgctgacatgccaatcagttctgctgctgcatttacattctactacatatttcatatctttaaaattattggcattagacctgcatataagaatcatagaaagtccaggctggaggggagctttaagatcatcccgtcacactccctcctttttcagatgagtatgattgtcagtaatttgaatcttgataacaaccaccaaatcaatgatgccacacttttttttttttgtacctttcaaacgttgggaactattatagtaagtttgaatgataactggttgtttgggaatcatatagtttcaacttattttcaaaacaactgaatcagaattttaaaaatatgccctcataaggcttacctaaacatagccataatgttgatggtatatgtgtgaaaggagatgttctatgcaaatcacctggcaatgagacactcaaccaatatcagctctctttccttcatgcatagattacctaattaacattactatagtggaaacattacatcagtgactgacagtctaggcgtttagagtcaaactgacctcgggtccaatcctggcgctgctactttccagctgtgtgacgttgggtaatttagttcatctctgttggcttcaggtagttttcttatatgtgaaatgtagccagtatataggcttgttttgaggattaaaatgagatcgtgcatatcaagtgcttagcactgttcctgtcacatagtaaacagtcgataatggtggttattaccatcgttttttggcatacccagcggcagcctcactcaatagtatatttaatcttacagtgatttggggtacttacacatacacctgtacacatgcatatttgggcacacaagttcataagatttgcatcagaaagactgctttcccaaaggttacctgtgaccaccatgtttcacaattcaatggcctcttccctggcctcagtcttcttgacctctttggagattctggcacttttgcacatattctcttgcttgaaagggttcataatctatcttgatgtcttctctacattccttaggtttcctttgt

SEQ ID NO: 139065 - DNA, 1044 bp, Homo sapiens
atcaattatttgaaaatatcagggcttttaacgtatgtaaatacgtagacttgcatatttacaagtaatcccataggccagaggcctttttgacatgaagcctgcaggagagcaaatctaatcaaatacaagaaagttcctctctgtggggaagacggacgctgagaatgctcccagatgatgcccctgcaggcaacaactgttgctaagagctgtaccatcatattgccaccagaaccggagagtctagcaagaaccataagtcattttggaaatgtgtgctctagtcgcttggcacattgttttctaaggtcatgatgctcaccagtactgtctttggctttttgtaggcttattggctccagaaatatttactagtgcctctgttttttcttaatacccacctacaatccaccctgtgctccctggccaaataggttagcaagagcaaagactgtagctctggcatttctccacaaggacagactcccattaaaatagactacttgagccattttggggatgcccagtttagctttctgtagctgggcttccatactcccattagagcctcaatggatttacttgacagctgagaatagtaaatttagtgtttaattttgtagtcagattataatttattgagctaaatggcacagacacacatagacacctaatcacacagtattagtatgggagaacatttaaatatcatagattgggtgtgtcatggaggcaaagtaccaagttctgttactaatgaggtgacttttgtcaagcactagctccactctgagccttaatttcctcgcctgtaaaataaaatggagcggatgaccattaagacaatggtcaataacataggtaccactatccctataatagcttttatggggaagtcttgagaattttgttttctttttgctttaaaattgctagatgataggaccatctctttaaaacagttttgctgtataacaaagcaaatcctgacacactctttatttttactatggtgttgattagttggaccagattattgcc

SEQ ID NO: 139066 - DNA, 1127 bp, Homo sapiens
gatcctgaagacaagagcagtccaaagttattcctgggaagtgagaatcaggcatcagccaaggctttgtcagatctgggtttgcagatgagggctcattcaatgttccttacaattgcaaaaaaatggacatgtgaaaactcacttgtaacttgaaggggcatcatttctaattgggagatagccacagagaaacgaaggggccaaaacattgctagtgtgaaaagcacataggctttggagtcagatcaacctgcaagtcccattctttatgtcttagatgcatgaccttgtccaaggccttcacctctgagccttgatttcctcacgtgtaaaaggagataggaaagagcatcctacaggggctattcttctaattaaacaatgtccagtcctcatgcctggatctccgccactggctctcaactcacctttttcctcctatctctctagcatagattgctgcgttcattttattgtagagggaccttggtacttttaagattcctgaactggaattcacaaggtctgagagatggttttgaccctgttatgactgtgtgaccttggttgagtccctttctctctcaggacctataaaatgcagagtttgggcttgatggtctttaagggtaccttccaactttgataggtttctaaacgatgtcaaggtcaaattctgaatggcctggttcactgtgctagaggatggccctgatcatttggcaagcacaactctttcccaaggcgacattgcccttcttaccattgtagttacatgggccctgctggaatgagtcacatactctagcttcttccagtttcttcccccccttggttaacttggcttggacattttggattctgtctatatgtaatttgattgcattttcctatagataagaaatataggtataatagcaaggagcacctcaccccccactgcttcaaagagagagagagagagagagagacctgatctgtctgccaacttctctttccctgtgggtccctggcctatccactgctacctgatttatgtcctaggggagcagcatagctatggtgaagatttataccaggttttcatcttcaaatgagctactacctctgttccttgtgtattc

SEQ ID NO: 139067 - DNA, 1044 bp, Homo sapiens
agtcagtataaaatctcttggtaggtcccacttccctcgccctctctcatagctgaagggtgaggtgaggtaagcctttagcaatgggcttggtatgtaagtggtcaataaatgctggtttttatgattatcaatcgccatcaatatgatagttactgggaaattgccctagttcttcagtcactcctcagtaggacgcaatttccttagtgctagtcattgcagtcccctttttttggttgtgttttggtttgccatttactcccatgtggagtgtgggatacaaaatgaaccctagatccatgccctggggcctagccttttcataaccctgccccactcattcctgtttgcttatgcagagcttcccgtcaatgaaagccccaaggtcctattgtaaggcctgctgtgaaaccaggtctcccccagcttctagctaattgatattctaaaaccttggattgcagcttgacctttatccttgtcaaatatctcttgggttttggcccatgattccagccagtcattggctctttgtatcccactttcttgattattttggttgcgttttttaattaggcgttgtgtgttgcagagacacatgatggtgcttaatcatgccaccatctccctcattgctctttgtggttttgtgagtcttgaattgacatgtgtgctcctcatttagccttcctgaaaaccctacctgctgcacctatactttcaaacatgcactgctggtcatctggaggcatttacctgaaatgttaccatggtgcctagacaggactctataaggcttaccctgaactcctaaatcctttaagtgttgaggaatgtgagaaatgtgtatgattttaagtatttgtctgaacttcataaattagggaaattacgtagtgacacggaaagccagatatacatgtgtgacttgtggattatccatgtaattgtttccttaaatcggtgcatacaaaaataagagtcagattttgaatgggcagaaacacacaaaaaacctgtattgcacctgttgttgggaag

SEQ ID NO: 139068 - DNA, 1032 bp, Homo sapiens
ctggtgtcagttctttttttttttttttttttgagacggagtctcactatgtcacccaggctggagtgcagtgatgcaatcttggctcattgcaacctccgcctcccagattcaagcaattctcctgcttcagtcacccaagtagttgtgaccacagatgtgcgccaccacacccggctaaattttgtgtttttagtagagatggggattcaccatgttggccaggctggtctcgaactcctgacctcaggcgatctgcccacctcggccttccaaagtgctgggattacaggcatgagccaccatgccaggcctggtgtcagttctttaacagttccaccacatgggatttagcaggggaaatgctgcagagtgaatgccagagactttgtccagtttcatgtatatgaccattggctctggtttcagagagacttgggtttgggtcccagaatttcttaattgtgtgacctgggcaagtcatgtagcccccacagagccacagtgtctttatctataaaatgaggatgctggtagagttgctgtgagattaaaggagctaattcaaacactcatcccattgcctggtgcaggaaaggtgcctactggatgatagctctcatcgttgaaactctgaagcttgggactggggtaggggacacttccactagagtacagacccaggaataactctggagacatgttgcaggaggcctgccagctttgttggagtgtgtccttcgtgctggttaatacatgggaaatggctcaggaacaatagcttgctcttgggagaatcccggaagtgacagtgtgaaaaatgatggttttccaaggtggtattccctagggctgagatttcttgtccttccttttccatgctcacaggaagaaggggaggtatttggtcaagaaagggtttccagaagaaagtggctcagagtcttgctcctccttcctcccctgtctgtaaattctttgcatttggaatgtgtgatgacccctgtctgggctttgcactcagatccctgg

SEQ ID NO: 139069 - DNA, 1746 bp, Homo sapiens
gagaccagcctggccaaaatggtgaaacccccatctctactaaaaatacaaaaattagctggacgtggtggtgggtgcctgtaatcccagctacttgggaggctgaggcaggagaatcgtttgaatctgggagatggaggttgcagtgagctgagatcgcaccactgcactccagcctgggcgacagagcaagactctgtattgaaaaaatatatatatatattatataaatataataatatattataaatatatacatatatatacatatatgtatatatatgtgtatatatatatgtgtatatatatatgtgtatatatatatgtatatatatatatatatatacatatatatatacacacacacactttggagtatatagttttaatggtggtaagtgctctaaaagaagaagcaagtgctatgagagcatatattagggacctttgacccagcttgggatttatgtttaatttgagacgtgaaaatgattaggagctaagaggggttaggctggagagagggtccaggtagagacaatatgtggatccaagaaggaagaacaaagggatcaacaaagtgatagaaataggccgggaggggtggctcacgtctgtaatcccagcactttgggaggctaaggcgagtggattgcctgaggtcaggagttcgagaccagcctgaccaacatggtgaaacctcgtctctactgaaaatacaaaaattagctgggcatggtggcaggcgcctgtaatcccagctacttgggaggctgaggtaggagagtcacttgaaaccgggagccggaggttgcagtgagctgagacagggccttggcactccatccagcctaggtaacaagagcgaaactctgtcaaaaaaaaaaaagtaatagaaacaaagacaggaagcaaagagaaagaagataatgacaaggattaaagatgcagctttgaggatggcaaaaccgcagagaggagaactattaggatggtgcaaaggtaattgccagtttcaccactaaaagtaatgacaaagctcaaggtggtggtaggagggacagctgagtgactcctgagaaaatgtaaagtgctgaacctttgtagtttggaagacttggttaaccagaatgattcattccccaattatgccacatcttcaagattttactgtaaaagcaagcaggctggccctggcattcctaccataagctggtgcttcaacttccacatctggcagaggctctagatgtcacataaattgaacatagtcatccagctcaaagggggcttggggtcattgagtccaattttcattttatagctacaaagtactgataactaaaatttacaaagtaatgcacacgtggcagccactgttctaagtgtttactgtgtattaccccatttaaccctcagaacaacccagtgaagtagaaactattatgattcccatttacagatgagggaactgagacacagagaagttaagtgacttgcctatggggtcacacagctcattagtggtgctgtagaccttgggtataatcacttgtctgtatctctcaaaaatcatacagctggatagcagcagatccaagaatggactcggctgtctcccagtgcagtgccctttctactatggtaaccagaactcgacggtgctccctcagttggttgtaaataacataatcccatagtaattgcaaggatgagaatgaacttttcagtctccctgtccccacg

SEQ ID NO: 139070 - DNA, 1022 bp, Homo sapiens
gtcagagcccagagctccacttgccatggaaagcctattgactttaatagtgaccatctggctgggcacctctgaagatgtctcagttaaggcctatttggtgaatggacctttgcttatttgaaagctacactgctgttccaacctgatcattgcattttatgtgatgggcactggaagtccaaatgaaagtttcttagaaaacactcccattaaatttaccagtccatgtgtgattgccactttcagtgcagtcagagcacagtcattctctttttattgaaagcatatggtaggtacttagagcataccctaggccagactcagttatggtgccatcaagggcagcaagaattaaaaagaggaaaatggtatccaggtggcagtaggaattcggtaggttggatggaaaatattcatagttaacgagctttcataaggagaacagaaacaagttagatgtgatttgcagatccataggcaatcagtctctgctgagcagaggggaaacttggagaagattctcagaagtgtgcctcacccttgacccaaacctttccctgaacatgtgcaataaatattattaagctttgagaatttctttaaaataatatctgtcaatggtaagtgccacatgccaggccctatgctaccagcatcatctcatatcatcctcacatgtatcctgtgaggtggaggatactatcccaatgttacagatgagaaaactgagacttaaacattaagttgttcaaggtcatacagctaagaagtcacagagctgctttgattaaagttctgtctgaggctgggtgcggtagtgcatgcctgtaatccaagcactttgggaggccaaggtgggcggattgcttgagccctggagtttgagaccagcctgggcaacatggcaaaaccctgtccctaccaaaaaattacaaaagttagccaggcatagtggtgcacacctgtagtccaagctacttgggaggctgaggtgggagaattacctgagcctggggagc

SEQ ID NO: 139071 - DNA, 1049 bp, Homo sapiens
aggtgggtggatcacttgaggccaggagttcgagactagcctggccaacatggcgaaaccccatctctactaaaaatacaaaaattagccaggaatggtggtgggcacctgtaatcccagttactcaggaggctaaggcacgagaatcgcttgaaccagagaggtggaggctgcagtgagccgagattgtgccactgcactccagcctgggtgacaaagcaagactctgactcaaataataaaataaaataaagcacgtctgctgccttcacaccccattttctgtaccatgcatgtcaacttctatagggcccttctcttgtatgggtgtccattaggtcatatcttgcagatatggcagagctagagacctagaggtaaagcaagatactaggaaaacaagtaaaagggagctattttctgggagactaggaaaaagaagagactaggaaaagtaagtgaagaagctctaactagtagggggccaataaggggcaaacaaaggagagaagctggctgcttagctaaccaagtagagagcctcggatctggaaggaactggaccgaacatctgtaactgggcagggctggccttgggcctgtcttgacttccttgaaatgtctcttttacctggcctccttctcatggctgtcatcaagcagccctgttgatcatgttcctgaggaaggacagaatggggttggggagattaagtttattagcaaggcaatttcctctagggagaccccaaacctggcttggtaactacagtgaaaggagagcgtttgagccccttcccccttctgcttgatctcctctccttcaccaggctttcttcagacctggttccaatcattataaggcagatctaaagccactcttcctgacactgaaactttgctgagcctggaaaaatcacagaggctcagtttggtgtttttgcatgcaaaatacgagaggcagaggtgaaggtgcattcctggtgccctgcggttcccaggcagtatctgagtgcattttcacctgttatcgcttgcctttcaaatat

SEQ ID NO: 139072 - DNA, 2104 bp, Homo sapiens
gtaactcgtttcacctttcttgtgtctcaatgtcctcatttgtaaaatgggcacaatagtcccaatcacataggttgaagactaaaccaaagaccccatttcattagcttagccttatccctggcagataccatgaactcatatgtcattataattatgataatttacttaccctttcaattaggggtataagatgctacacagttttcctctaggacagggcccgcaaaccatggcctgcagcttgcctgtgagctaacaatgattttcatatttttaaaaggttgaaaaaaatcaaaagaagagtgccgtttcgtggcatagggaaattatatgaaattcaaatttcagtgtccataaataaagttttattggaacacaactgtgctcactcatttatatattgtctatggctgcttttgctctatcatagcagagttgagtggttgtgatagagattctatggcctagaaagcctaaatatttgccaccttgccgaccacttgccctaagacatttagccatgtctctggaacatcactgtgatagatagttcaggaattatttgcatattatcatcactgttattccaaaactctgactgcgtgtgtttctgtgtggagagtgatttacaaaggaagaaattatacaagtcataacaaaaagaaaaaaaaaaaattacacaggtccatgtaagacaaatgagatgaggcttttgtggcagttttagctaaggactcactttgtgccttcgagggatcagaaagaatttagaagtagtagcaatattggttaggagaatttacagattctcttgttttcttttcctctatcagtaccttctctgcaaggaggagagaatggatgttagtttctccttgtaagatgaattgaattgcttgtgttagtgtactaggactctgggttggttgtgaatgtggtataccaaggcaaagtctcatctgagcaaataccaccataacaccctgttctcccccaaaaggcaatctctgtagagaattataaaatcttagaatatcaagattggaaggagcctggagatctgagggaatgatattgatattaatatctccttgccgatgtagatacaatatcctgtttgaaggcaaaacattgtgtaataaacccagtctactcaatctattcaactaaggtggcctctagtgggtgtctgagtactggaactagatttgaatacttgtgagatattaaatttcatatgctttacaaaacgtgcagccatccgggcacacaaacaaaatgcccacttttggatgtgaaagtgggggcaggagtttttcccatttaggagctaaaagctctggagctctggtcctcagattcatcttgtgtctggcctgtggtcgcagtgagatgccttttcagtagggatgaggtatacttggggctgggagaggggggacatttggaggtctggcctcccaggggtaggtatgtgtttagccgggctatgcagatgaaccaatctgggtgtctctgtcagggaagaggctaggaaagctgctggtgagaggggtcagagactggtttgccccaagggggatgggggaggcagggaggctgtagaggagctgttgggccagatcttgttgagaaaatctctcagacccgagacttctcccctcctctcatttcctatatttgggctttcacacttaagggactggtcttaaggagagatgtactttttaacatttgatttgcccatgttgtgccccgtacttctgcgtaccaccagaagaccacaatgacaaagaccagcgaaggccaaaggtggccatgtgtgtatagaattgacactccaaggtcaccggatctgcaatctaccaaacagtcttgactcacaccctcaggtttcatatttgaacctcctttgcagggctggtcctggctcctttcaccttctagactgcctttcctttcttactgtcctctgagaggcacactgaacatctgtggacagtggcagttggtagctatatatatacatgtatatatatcagaatttcctctttgtacactgtagcagtggacttccattttgatgatattatacagggta

SEQ ID NO: 139073 - DNA, 1100 bp, Homo sapiens
gataggttcctacagttctgtaaagtatccattgcttctgaaaggccttctttccccattgtctttgacaatttagattttccaagtgctaggattttggagaaagtggagccatgagcccaggcaagtggggtagcctgataatgccctcccatgacacatggggctggggatgtaaaaacttcagagtttccatgtcaaataatctcctttgccctgtggccttcggttacaggaatcatttatattacaggcacattttgaaatatcaaaacaaattggacactttttccctattaggaagaaaggcatgttaatttaagtgtggagtgtgacatttggaaatgtaaaaagaggcttttggggagtagttgggggtttgagtggaatatctccctttttgtatatctctcttgtttttattcatcctgtgtcttattcagatagtgattttcattcacctgcctgatcttctggaacagggattttagagaaagccattttctcagcagctccacaagggcgagatttccaaatgggcaaggaaaggctgcagagacacatctagcttggaagtaaatgcaccaagccagccaaattggaattgtcttatagggatccttgtgtgctgtcacagaagagttttcaggaggctttcctttgggcactaatggccaaccactgctgctgagtttctcccagccttctggagggaatgccagccagcgcactctcagctgtgacatgaccctcctaggagctgttcaatgctagcgccgttttgctctgatgcccagcaccctctgcttttagtcactttccttagcgtcctttcgcagtgcttgcatttcagccaaaatcgtgcctcgtgacttttcttttcctagagttttcgcttctcacagtgaagaatctatcagctgtttcctgaatccttctatgtcttttaaggtgttaacattttcaattttgccacattcagcatttttggcctactctgacctgagctcgataaagagcatcagaaattgagtaaagacagaaataagtccctataagcatgagccctggcactgtccacttcctcctcctcccctacc

SEQ ID NO: 139074 - DNA, 1049 bp, Homo sapiens
cctcccaaatagctggaactacaggcatgcaccaccaggcctagctgtttaaaaaaaaaattacagagatgaggtgtcattatgttgccaaggctgatctcaaactcctgggctcaagcaatcctcccacctcggcctgtcaaagcactgggattacaggtgtgagccaccatgcccagcctaaagtgatactgatgcaggctatcccttaatattttcagaaatattattctagtatctcttaacaccaagattggaaccagcatcattgaacgttcagaaaacgaagactcagtggggaagggagcacttattcttctccttatttccagcttatgattcaggcctcttggtctcttagaggcagatgctgaaacgaacactctctgtctgcttttcagacaatctcatataatcatttacttgttacaaagaacaatggagttggattaaactgataaagtgttatttttcaatgcaggtcaggaaggcattgttggtttgttttgcattgctcattataatttctatttttgtcctggggaagctcatggtaatggaatgaagcatcgaggtggtttatgggccatgtgataggatcataaagttgaggttgttgcttggacaatacctttcttagaatagtaatccaagcaaagagaacatggacaggaaagaaaagaaacaataagaagaaacttcagttatttagccagttgtatgaggttttcattgctcagatccttagttaaaatgtgggatcagaggcctgcaggtaatgcctgagctcaggaaaggcagggaccatgatgcttttgcattcctgatacgaaccacagtgccaaccacattgtcagtactcaaaacgtatttgttgaatgaatttctgctaattcctgggatctattctcagagattctgattgagcaggataagtaaatagtttttcacagtgtggtccctgaaccatctgcatcagaatcacctacagggcttgtttaaaaaatgaatgccagggccgggcatggtagctcatgcctataatccca

SEQ ID NO: 139075 - DNA, 1114 bp, Homo sapiens
agatgcgaatcctgttcaaccacctcaatgcaagttgactgtagttgagtctctaggatggggcattcttaaaaatcagaacaaaaattggctgtgattgtgaagagtgtatggtgaattggcaagatggtgagtaacaaggtggagcagcctgagtttttaatcaccttgattacatgttccaaggtttaactttgtggcctccactgtttccctaattttacctgctgcgatcttattttacttttcattttattctctaatcaccgccaattagagccctgagtccatgctggttctgttgtctgcctctcagcctaatgggcctctttgtactgaggcacagaacccagctggcagcgagacttcctagggcccggaagcttcattactctttgttggcagtgaactctaaagttgctgtctttggagttgggttttctcaagtacagtcacttaacatttggtctcaaagttgttgtttttcagatttttttctcttttttcctaagtcaatcagatgcatgagctaattataagccagcaaatattttgagaaaacttccctccagtggagacccttgcacaaacttcagactatattcccagtaattaatatgctccttttatttcctttgaggtggaaaacagtcattgacaatcattccctacccatttggttcaaataactaattttgtacctgaagactaattacagtagtgacaccatcttttcctattaggtctctcacttgaagaactcagagcaatttataacctttgaatcttggggactagtttaatctgttcgtgggcagcatagcagtgaacattgttatcagaaatatagttaaacctctttaattgagcccctattaattcaaaaggtaataattcaaacagtgtgaagaacaaacttgaaacgtctatgacaagaagaaagtaagttggcaaaggggttatttaaactgccaagtagagcacacttttagaagtgccagttcacatgcaaagaactggtaagtacacacaaattgttccattaatagactcagaatcttaagattaaaagccctgtagtacaactgttcataactcaaaaaacatttgttga

SEQ ID NO: 139076 - DNA, 1020 bp, Homo sapiens
tctcgaactcccaacctcaagtgatccaccagctttggcctcccaaagtgctggctttacaggtatgagccatcgtgcctggcctagaggcattattctaagtgaagtaacataggagtgaaaaaccaaaattcatttgttctgacttataagtggaagctaagctgtgagtctacaaaggcatgcagagtgatacagtggactttagagactcagaaggaggagggtgggagtgggccagggattaaaaaaaactacacattaggtacaacatatactactcaggtgacaggtgcactgaaatctcagaattcaccactatataattcatacatataacccaaaaccacttgtaccccaaaagctattgaaataaaaaaattaaaaaaatatgtaagttccatttcagcatgagaaatacttcttagaggagtgttcataacataggttagtccccatgagatttgtgcataaagaggactccataggcaagccattccatatcttcctcttggagacttaaaagacatgttcgttcgtatattaaaggctatacagctttcaaacttttttatcaaagtcttgcagtttgtaactttgactttaacccagtattaaccaaactagtcttcctacagagcctttatttcgtagtccatgttccatgggccttgtggcagaacacacaatgggaaatgctgctttacagtggactcttggctccccagtaatggctaaatgcctgatttggttatagttctgtcagcccctgttccttccaaacgagaatcttgtgcaggaagtaagaaagagaaactagcccaagctattttgacaacaggcctctgactgaaacaacctccctgaatggttgataaacattttccctctcttaagggaaaatcatgcacagaaacaagcacatataaataatttaccaagctgtaatatgctgtaaataacaaccctgctaaataatgaattaacccaactgctgattcataggtaaatgtctcttgt

SEQ ID NO: 139077 - DNA, 1108 bp, Homo sapiens
aggcttagagaggaaaggactttgcccagagtcacacagttttagaagtgtcagagcttgggcccacatcaggactctctccacccaatgagctatgctagtgtttgccaaaggccttctccatagaaagcaacaaattcagattaggaagtgtatttcaatcactaagtagttgttttagctttctagggttaacagttgacaaactttatcatagatgaaggtatccctgaattaagagatggatttcagtaatgattgctataaaatgagtttttggtaagtggcctctatagccttgtggatttcaataaaatcagatgtccttcaaatggaaaaaatgttgaccctgctgaatataataaaatggcactttttaatgcagtaaatcttttaaactcgcatttaagagaaaagcaatgacttttaaagttaaagtttaatggtatcccttacttggaatacgattccagttggagaataaatcatagaataaaaatacttagagtaacaacaacaacaaaatgcttagagtaaccatagaatagaggccaggccttctggcaggtattcaggctgccttccttatctgacaaactattcacaacatagagcagtcagtccctctaagtctggcctcaaaggtcccaacactttgaattcctttaccctttttcttctgactttggccatcatttcactttatggcctttgttcaaagatacactgtctgcttttctacttttgcttggaagcaaaatcattttagaaagctaaggcctgaaatagctagttgctacttaatgtttgctgcttatcattgcatttgctgggacctggtgcttgtcatgcttatgcagtacaaggagggaccaaagaggcagaagacagtccctgccatagtgaagtgtagtcattttagaggacaggactaaaaaacacgaagcaatgaacaaaccccccaaaatacaatagtgtgctgaatgatgcagtgcagatacttcttagaggtatttaggtgtagctgggctagattgtttctgtattgcatcaatagattggtccatgttgactattccacttcacaatatctcagggatggacaaga

SEQ ID NO: 139078 - DNA, 1082 bp, Homo sapiens
tcttagaaatctggtgtgtaatttatacttacagcctacctccttttaagctggctatatttcaagtgctcaagagctatatgtggctactggcgatcatattggccagcacaggcccaaagaaacttctagtggagtctttcttataaagatggagctacgtttgttcataggcaaaaccaaaaccaaaacaaaaaatgactctgtatgtttattggtcccatgctctgtgctaggcactagagtggggagacaaaagggtgcagtgcagcctctaccgtaaagcagtcacacgtgaaaagtgaaatcattttggttgtaatttataatgtgtccaagcacaaggcagtttttgtgattaattctcaagcaagtgattctggcagcttaggactgtgagtttaaaggagaaagtaatccctactatttgagatggtcatggaggacaggggacattggacaaagtataatatttgtctgagatggggaaagaggagaacaagcagttcatgtgggggagacagcttgaacacatctacagaagcattgtgacacagagagtagattagcttggctataactgagaattcacataaaggaaattgtggaaagaaagatgggattccttttggctgtattaaagagagttggactatatagagagatggctaagagacctcagttaacaacaggaatgaaaataataatcgcagctagcatgttcctgattagggtccagtccctgtatcaaattctttgcatttttttgtcactgaatattacaaatgagaaagtggaatctctagagaggtagaagtacttgtccaaggtcacacatccagaaagttggcctagcaaaattttgaatacagaaccttctgagttcagagcatttactttaaccatcaggagatatgctcctgagaacgttggaagcagtgatctctgtgtttgattaatgggacgccccccagccctattgacaaaggtgctgcccaagtgctgacgtaccacctcaacataggacagagaatttccaggccaaggattctctgcagtttgtgtcctctgaacagatacaa

SEQ ID NO: 139079 - DNA, 1026 bp, Homo sapiens
tgtttagatttagagcttttgaaactttcagaatataaattaaaaattatctttgtaatcataatgcacccctaatttacatgtcctgatcttaaatctattatttatattagcttttatcaaaacattcagataagtgatcttcaaatgattagtacttaagtactggttggagatgaacttttgcaagtgaacgtcatacaatctattatttctattggagcttaattctgaagctcagagactccctagctctcctcgcctcaccatggtaatttattattatcctttgtctcctataatgtttgcttctttggcctacctgtagcataaaccttttggttgttctgcagctatttcagttaaataactcaagccctaaaaaccacagaaagaagagaatgtgcaaagcgatcatatttatggaccaccagatccttctcagcataattgccaggctttttatactgaaaggcaagaaacagctgccttgttctactttggtgtccaactcagctgtttcagattcatcctgttgctttaagcatctgttgacaggtgggaaagctcactgtgaagagaaacattgttgccctgggtggcttctgcctaagacaggcctgacccttttgtttctcccctggaaaaggaccgaagtgttccttccagccttattaagtacagctgtcgggtacattttagtagatgagaaccatttccaaagtatctcggttctgagaactgagaggcagtgtccagaaggtagttggacaagctcgtgtgctgtagaatgtctgtaagtggctgggacttacagaggagaggcccgcacgttgctagtcctccttgtcttggacatcttgagcctcccacttgaatatcctcttaggctctcattttgtaccagaaattctggaaactggaaggctattttgttggaaccccttattttacagattagaagaccgatgccagggttagttaagtgttttgttttatgctacaaagttggttagtggaattctt

SEQ ID NO: 139080 - DNA, 1004 bp, Homo sapiens
tctcatgtatttgtgctttacagactcttccctgtgttggttgttttgtctgttttgtctttgtccctcataaagtcatggcagctagaattgaagatcgcatttcgggagtgttctgaccagcacaaatcagaatgctatcatctacaatcccctcgttctaggtaatatatttctagtaatgcccaattaactagtttctgtgatagtgcctcacactgctgactcataatgaactgttgattgctaaagcctcctccaagctgcgtttggaggtttggcatgtgaatctatttatacccacttttttatatttaaaaaaggcatcacattgatgcccaaatcaggactgttatgcacatgtatgtagatgagtaagtttccctttatgaatttaaaaaaacacacacacgtcatttaactttattattcttgttgctttgcaaaatattaaggacatcttgatgctttcagaatgaacaccaaaacccatgtaagtggtataatacttaacaatgttcacacatgaaaatacataagtggtttatttaattcatgatcaattatttgtttttgaaggaattttcagcattttttatttggacattctggaaatgaaatagtaaacatgattagttcaggtagcattgagaacttttaacggatataatacttatgaagaatttatttgcagcagaaagtggtcacttgctatttataagatgaggaagatagtgtgagccaagtaggaggtggagataacctcctgccaacagatgccaaaatgggagactgccactcggggctgcctggaatgcaactgcacctagaagcatactgtgttgtatgtgtaaacaagcaagaacatccttgtgtaaatgtgtggtggctctgctccttggagaaatagaatggtttctcaacatcattttcttataaattccttgctgttaaatcagtagccatttatccagatacttgtagtggagctagagatccccctc

SEQ ID NO: 139081 - DNA, 1027 bp, Homo sapiens
gtttttaaaagcagaaggttccttgtgtctattaaaattattttaatttattgtcatattactgtaaattggaaaggaccacaaatatattatgcttaacttccagattcaagtgtcttgcaataagttaaacacatgtaatggtttatgctctttaaaatgtttttgcacttattttattctgcccagcagggcagagattattgtctgagtttcataggtgaaggcgttgaagtacagatgcttatccaagaccctgctgtttgttagaagcagataccaggacaagaaacacagcttttcttatttcacagcacttggccatagcaactactttttgctgttttattcacattgacatgaataggttagtacctgaattctttaagacagatgaaaagtaattaagtctgagtctcctcaaacaagatatccctctgaaaagatggatgttgtaggatcatgaagatggcagtctttaaaaatctcagcaaggaacagcattgtgactagcgatagagtaaaagctgtgagaattgcacagattccaaaacgctgttaagatgatctgctggtcctttttccaaatggggaatatggtgatatggttttggggtatttgtgctttatttatttatttattttgagacagggtctcactgtcacctgagctggagtgcagtggtgtgatcaccactgcactgaaggctcactgcagccttcacctccacaggctcagataatcctcccacctcagcctcccgagtagtttcgactacctgtgcataccaccagatccagctaatttttgtattttttgtagaatcagggttttgtcatgttgcccaggctggtctcaatctcctgggctcaagtgatcctcccacagtgctgggattataggcatgagccatcgtgcctggcctatttgtgcttttgatgtacattagtccctaactggctcttgagcttctgcttcatgcctcccacagtgccaactctaggattgtaagctccccaccctgat

SEQ ID NO: 139082 - DNA, 1039 bp, Homo sapiens
aaaaacagagcttttaaaaaatggaatgactttaaggaatctgaagaaaagataaatgtactcctgtatgatttttatagtgtttgcaatccagtgatcattctcacattgtttaagtttcagtttcaaggtgcgttgtccccctttatctgtggggaatgtgttccaagacccccggcggatgcctgaaaccctatatatactatgttctttcctacacatacttacctatgataaagtttaacttataaattaggcacagtaagattaacaacgacaacaataaaatagaacaattataataatatgctgtaataaaaattatatgaatgtagtctttttctctcagaatatcttatactgtgatcacgtatttcctgactgtgagtgaccatggctcactgaaaattgaaagtgaaaccacagataagggtggggactatgatagtaaggtaagattggtattaatatattgtctgagcaaggcaactaaatgtgttccttttggaatgcatactgttacaattcaggtttaattattaaacagcattggtctaagtggatgaaggttctgttttcgacccataatttaacacatgtcaagtttaaatgtacacagtaactcaaaaaacggcctgcctttggttgttgtttccaggatactgtgagcattgcaattagcaataaggaaagcactgaccaactcccggaaccacatctagttgcctggcatggaaaggaaatgcttttattttagaaagtcacttctctgcatgagcaaggaacagcgagagtcattttaaactattgtagttgaattccaaatggcaactgaggtggtcccaagatttgggccatgccaatgtagggagtagaggattaaacacagtccaacagttttacaaatttctagttggtgggtggctgggaactgtttattattgttaatgttactgaaaaatcacttgtttcgtgttaatacatcatcccttctccagtcctccagccccagtgaattttgtgttgatatagcaatgtg

SEQ ID NO: 139083 - DNA, 1057 bp, Homo sapiens
cttgcgaggctgaggcaggaaaatcacttgaacctgtgaaatggaggttgtggtgagccgagattgcaccactgcactccagcctgggtgacacagcaagactccatgtccaaaaaaaaaaaaaaaaaaaaaaaaaaagatacacatgcctaaggacccagactggaagggaactcaaggcaaacaaaaacagttggtatgttagggtcatgggacttgtttttatttttatttacctttgtcctattttctcaataaactcaaactagaaatggaaacacagtcacagaaatgaaggatattcataaagcattgtttcctgttggaagctgccttttattctcctttgccctcagacatgtactcctcattttgatgagcagcaagtgatcagaattatccagccttcagtcaaacataatctgtagaagaaagcactgctttatgcaaggagatttactgtgtgatggttggcaaaagaaaggatgcacaaagactctgtgtgggcagatttagcagaggtactgaaagtgaaaggagaggccatctggtagaatgtgctgtggcaaattaaactgagttttatgaacatgaaataccagaagaaaatccaaatgccctggacttggaaaaagcccatctgaggcaccataaaaccaatcaactacagactgacaatatgccactcataagctcagatatgcccattactagggacagcatcattcaagccagattttgcagagctcatttgatgtggatttcccgtaggggaaaaaatcaacaaattacccaccgtgtcccccacacatgcgcagatgcctgatacagagctactgtttcaataaatatggtaaatgcataatgatctggaaggcattggtttggcttctcctgcctcacattcattagtgaactctgacacccaaaccagacaactagacttgggtatggatataaggagccatttttccctccctccctccctcctttccctgcttgcctttctcttttccctcccaattattttcattctttcctctcccctccctccatc

SEQ ID NO: 139084 - DNA, 1035 bp, Homo sapiens
actggtatctcaaaggttaatgaaatttgcctaaggtgaaggtagattaagccttccattctcacacaaattgcccatcttccaatcccctttgtaccttgacattttcaacacaaaggggttggggtgctcagaggattacacaagcaagcacatatttgtcacagcacctgattatagacctgcattttggaagagaggtatttcaggatcttctcattactgaagcctctcattgtaggaccatggtcatttttaaatctcccacattgaaatgaccagttggcaaaaaccttcaattacaaaatctcttccaaagaggctgagttttttttttttcttggatcacttcacatccttttgaataccctgaggcagtatttttatgggctaacagcaaacagagtgtcgtgtagaaccaagtgtgtcccttcactttctccaccccctgcaaagtttgtgatcttcaaagcatgctggattttaaaataaaacatctacttctagtccaagcctttggctgtagactttgggcttaagtgtgtttttccacagaggtgttacatccccatttctatcagctaaggaaaatgaattcattcaaggtctcccctgccattcatcgaggctccccaagaggagctttccagaaagatctgtgccaattgtaaacttacaagatcctcagcccataacaaaatgcccagacaccttggctctgctgacacaggctgagagagataaaggaaacagctggctgaggtcctgacttttttttcacatttttttcactttttttttcacaaaggcccgctagcctttgcagactggggactttaagattgttcactacccatccagcagggctgggcatacagataccaaagctccatctccagagacgtgaactctaaccaaggatcctcaaaccacttaaatcatgaacctgaaccttgaaatgaagcaaacattacatttaaactcccatgtttaaaatcagtttgcccttttcgctcactctttactctgggggat

SEQ ID NO: 139085 - DNA, 1634 bp, Homo sapiens
accacattttgtgtgtccattcatcagtagatggatatttgaattgtttcctcagtgtttccaattgtgaataatgttgctatgaatatttgtatacagctctttgtgtggaaatatattttcattcctcttagatctgtacctaggagtggaattgctgggttatatggtaagtgtgtgtttaatttttaagaaactgccaaagaatgttttaaagtgtcagtaccattataccttctcaatagcaatatatgagattccagtttcaccacattctcaacaatacttgttagtgtctatcttttattacagtcactctagtgaatgtacagtggttctccttttgcttttaatttaatttccctgatgtctaatgacaattgatggcatatacttattaaacattcacagatctcctttgatgaaatgcctattcaaatattttgcttataattggtttatgttctcattattgagttgtaagagctctttatatagtatagatacaagtcctttatcagttctgcccataatgaattctctcagactttgtttatctgggaatagccttattttgccttcattttcaaaggacagttttactgcatgtagaattattggttaccttttttcatctttcagcattttttttttttgagacagagtcttgctctgtcaccaaggctggagtgcagtggcctaatctcagctcactgcaacctctgttcccaggttcaagcaattctcctgcctcagcctcctgagtagctgggactacaggtgtgtgccactacgctcagctaatttttgtatttttagtagagacggggtttcatcatgttggtcaggctggtctcaaactcctgacctcaagtgatctgccctccttggcctcccaaagtgctgggattacaggcgtgagccaccatgcctggccctctcagcattttgaatgttactccactacctacagcctccattgtttcagacaaaaagagcattaattgtattgatgctctactgtacataagaggcttttttctgttgtttctttctagatttttctatcctgtcttctcttttttgtttttgtctacatcattatcttccccttccctcccctcagtctctctctttgggctttcaacattttggccattatgttcctaggtgtagaatttttgtattaatcctacttgggattctttgatctttttggttgtaggctatttattttttaatcaaatttgggaaatttttagctattatttcttcaaattcttttactccctttttgtcttctctcctagaattttcattaatcacatgatacttgatgtttcacaggtctctgaggctgtttatttttattcagtcctttttcttttcttcttcaaataagataatttctatagatttatcttccagttcacaaattctttcttctgccatcttgaatctgctgatggggctctgtgggaaaattttaatttctctttctccaattttccagttcagaatttccatttagtcttttgtaaaataatttttctgtccttactgaggattttaaaaatttgttatttttgttgtcatacttcaactctttaaacgtgggttcctttagttctgtg

SEQ ID NO: 139086 - DNA, 1079 bp, Homo sapiens
tgcatttagtcctactatatagtcttgtgttgctaattccactttagctgtggcaaatataccagtgtgtagccaccgggccatgaggtaaattgaatccgtgtggagctgacagttgaaaaacctctgtctgcctcagttcaggaaacaagagcgtgttcaactcactttgggaaacccccaggcattaaaattttggcattttcatgttttgagagaactgaggagtagccctgttttgataatcatttaaaaatattttacttaattagagcagaatttgctcaggcagaaaatcacatttatatggtagccaggctgtaacacctcatagctacccattgtctctaatcagaaatgacagcctggtgactggctccatgctgggtgaagtccagcaaactgcaggccctgtaagtgcctaatcccaaacctgggcttccagtggagttggtttttttttttttttttttttttcagtggagttcttcaatgggtctggctttgaaatacttctatcctttctagtttaggaaagcaatggcacaagaaacccatatataagtcagctacttttttgatgtgtaattcacataccatacaatttcccatttaaaggctaaaattcagtggtttttagtatatttacgaagttgtacatccaaaaccacaatcaattttagaatattataattccccagaaaagaaacccctcactctttagccttcactcctagtctccccattcctcacacctctaggcaactactaatctactttctgtttctagagatttgtgcattctgataatttcacataaatggacaaatgcagtgtgtggtcctttgtgactgtcttcttggttcaacatgttgtagcatcaagcagcaattcatttcattttattgctgaataacattccattgcatgaatgcacaatttatttattcattcattggttgatggacattcagattgttttcagtttttaactattgtgaataatgctgctatgatttgtgtacaactctttgtgcagacatttgttttcatttctcatggagtagaattgctgggtc

SEQ ID NO: 139087 - DNA, 1034 bp, Homo sapiens
attagaggcttgtatttaccgaggcaaatggacgaaaggcaaggaaccagtactagaaatataaaaccatccctgtgttggatacgccctggaacaaaggaatataaggccaggattttactttctgccctggaactgacttccctttgactctgcaagttttactttcctgctttatgtctgataggcataaaatgcctaccattcttctttctaatacaattgtaatttcatcaatgggattagtgaaggcactaacaaaatctaaattctccatagtactgatcatcagggtgttctttagtagtgacttaaagaaaatcatgctctttgaaagaatatatataagttgcctttacattgctcactgagaaaagataatggagcccaaatctaggcttcttgttcctcgcctcccttttttttcctgggtgatcatacttttcaaggttatgttctttcatattcagtgttgaccatgcaaaactggtgaacaagaattggttctgggatgatttgttccagctataaagtagaaagcattttactaaaataggatgcttagatttgtttggatctacagtttattcttaactaaaattccaggaactgttggtaacagtctagattcatggcaaccagtttttacaagaattagaaagaaacgaataaaatgttctcattataaggttcaggaccgaatttgaaggctttcaggattccagatggcaaatggtagagcgaacgtgaaaatattagaaatttatgctcaatgatcatcatcttctgtccagtgaagaatgtagtttaagcaggatgggtgcgggcgtctgatgtcctcatttatttccacctctgtagctatttaagtgatgatcattcttggtggtggttaaattatgatgcacgaaatactatctccctaaggaccttgctacaggacagaggtgattacaagaaattgttgctgctgatgtaatgtttcgtataccaagattaaaccacaagatgaagtaatgtacattttttgcctt

SEQ ID NO: 139088 - DNA, 1073 bp, Homo sapiens
tcacgggggttgttctttgttcatctttccagggttttccgtacgctgactaatgcttacagctggctctctctggagagaagtgctgggaagatcaatcaaatgaaatcttaaagggtaaatcaggttttcaaatgtgttcaggcagctttaaatcgtttcagtgagaagaagtgcttacaagggcagaaatttgcccagcgaaatgcctcccaatggcaacagaacaatcacaccttggatggctgctttgtagcctgagtgtccagttcttctgagatttccaatggccatttacaactcaagagtgagggacaaaatgaagtgcatttgacttgaaggaattcactaatgcaagatcaaagttgtaaaaactgtaccttaatatgctctatcaaagggctgtatgcagatgttaagaaagggaagctgcacaaaatatcccttttcaataatttcacattttctttagtttttcagctcctataaatctcaagaaataattaacatgaaacctatattatgtttcaggaaaaactccagagagtctttcttaggcttttggaagtcagtgatgctgttttctgtcttcttagagaagtcctaaaatggaaaaattttatcatggaaattgacccattcagagcagagagtttatgtgactttatggtacaggaaatttgaaaatcgcatctcatcttttattttctattgtcatgttaaactatggttgtgcctatgggattaagtgaatattctagccacttgcattaaatgattagccagtcttttcatagtgacagttggttgtatgtgctgctagtcctgcagcggtctagtctgctagtggttaactatggagaattggtcagaggagtccctccccctattatacacatctcattaaagactctctgccactgccaaaccagaaaaggcaacttatttcacgattcattaaagaaaacataattgggaaggtaattttgtaaagtcatcatcaaacatagtccaccacccagtaggaattatcctctcattatctctttttctagatagtcattgacattgtt

SEQ ID NO: 139089 - DNA, 1165 bp, Homo sapiens
tcaattattgtatgttgaataagcaaaattataatttttaagcaccataaattcaacctgccaaaagccaaatccaattttttgtctttcaggggatggcacaatagccagcttttcaggaacctgagtgttttccaaaccagcacttttcaaacttaactatgcacatgaatcactaagttttgtgaaaatgaagattctgattcagtaggtcaggggtggggcatgagattctgcatttttaacaatctcccaggtgaggctgatgctgttggtctgcagactacaccttaagtagtaaaggtctagaccctggtctctaccttatctccaaaatttaatccatcaccaagtcatgttgtctccatctcctttgtcccaactcatgtctgtttctgttgccaccactttagctgaagccttcatcatttcactgcagagattattgcaatagctttcatgtagtctacctgctctttattctccactccactgtctatactgcagccaagatgatatctctcaaatacacctttgggcatgtcaatccattgttaaggggctttcaatgtaggataaagtaacagaccttctgtggttagattgcctttatattgggtgggagcagaggcaggggcaaaacaatgtgaggactgaagagccaagagcttagagtactggtggaccagtagtagggaccaacccatgcagatggagctgcctacagttattgtctcctccatccatctagccagttgctggttagctagctgcgcaggcatccaacatgccaaaagtattggctcttggaccagacaagctttttcatgtcatttacgctaaaaccccaataacttgatgtctattctttcagagtctctggcagataagatgcctcactgttttttttcttttaaatcaaaatgttagctagtctgggtcccatcagtccaaaatcccttgctcatgttgcttttacgtttgaattactgagaattttagtgtacatcgatcaacaatttgttctatatcctgtacctaaaagatgttttgccatttcctttttcttccagatttttttttctgtgttttaagttggggtttggtagatggttactgtgtgcacattctcacggaggtgtaagcatcgatgatactgtacctg

SEQ ID NO: 139090 - DNA, 1026 bp, Homo sapiens
ggagcccccagccatcagtcattcattagcacacaaaacatctatcacttcagagattccaacagtttttggaggaatgaaaatcaaaatatatatttcttattataaatcacaataccacagtgattattggtatgtatgcttttaattttaggctaagcgaggattgattctattcaatttttccctcaggcttataggaacacatttaagggcatctgttgatgactcattaactgtttcaaacctaaaatgtgtcaaatgctgtgactttgcaactattgttgctcttccctttagcacgaaatactttaatgatctcaagacatttatattatcagatttttgcatatattcactaaaatttggttttattaatggtctcgatgtgtcccataaatattcctggtttccaacttgagctggatttattaggaagaggcaaaatttagcttatgtgccatacctgaaggaagttacgtatcgtagcttgtgatgctgtgggacagctaaagaacaagcctttacctggtgacagattttaactggggaatagttattgtaaaaaatattttcattttttttagactacaagatatgcgggctagcattggatgcttgaaaggaaaattacatttttgctgaaatccaggcaatgcaaaaattttatggacttctatggatatttcttgatgcttagagatttgtttttttaattgcaaatgtgaattgtctatttacaaatgctattacatatggagcgggcctgtggtgtatggcactattccttggactaatggtacccaggttccattctctgctcagctcggtggctctagacaaagcccctaaaatgctgtctgcttcagtctccttaatggtgaagtggaaatgaatacctactgtcacttaactcatggagatgctggactgataattagatcatgtaagagcactttgagctgtattgaaaaatatgttgtctcaaattaagtagagtctatggttttgtaaatataaatatat

SEQ ID NO: 139091 - DNA, 2723 bp, Homo sapiens
tctcaaactcaagcatttctttatagcaatgcaagtatggtccaatgcagtccccaaggatccataaccagtcaaggattgggggaaaccttaggaagcagcatgagtaaagggagtttcaagaggaagtgttgcttgtacttatgggctagaatgagatctgtgacctcagaatttgatagaaaccaggacacctagagcccagtaggatatgcgacatattttggactttagtctgagagcagtgagaaggcattgggactttttaagtagaggagtcatttaatttgatttgtgtttttactgaattcctctggcttctgtgtgaaggggctggagagtggcaagaacatggcagtgagttagaaggctgcagggagcagcccagggagacagggttgtggcttggcttggggaagtgattgtggggatgcagagaggtgaatggattcaggaggtttaggaggaagaacagaaagaatgctgcgagtaaaagatatagatggtagggatgagagtgaggaagcaaggaagtttctgccaaggattctgccttgagaagactggagaagctgtgataagcagggcagtgggagagagtctttgtttacatgtggaatttggggagactgtggagtcgccatgttgagatgcccacgggcagtggatctgtggatgggggggctcagtactgcagacatagactgggagggttttttgtttgttcgttttgttttgtttttgagacggagtccccctccgtcacccaagctggagtgcattggtgcgatctcagtttactgcaacctccacctcctgggttcaagtgattctcctgcctcggcctcccgagtagctgggattacaggcacacaccaccatgcccagctaatttttctatttttagtagacataggttttctccatgttggccagactggtctagaactcctggcctcaagtgatccacccgccttggcctcccaaagtgctaggattataggtgtgagctactgcgctcagccagactgggagttttgaggtgctttgtctcatttatctcacttaaaataatttcaaaatatgttaaaaggaaatgttatttgcaatgcatagacaggttttcctcgctagttgctgaggataaaatccaaacaactggacctaaacagacaggattggaagaggctgttctggaccaaatgggatgctaaaccttagaatggattgacaagagaaggccatgcagaatggtgagaaggccctacttacctcagcccagcttcaaggccctaagtgagggatacctggaatgcctctgaagactggcatttggatgcccattccttcccattgcagttgccaagcccaagagcagtggagaacaactgtaccttcttgtcatgaagtgtgtacaccggaaaaaagtaaatgcttgtattttctttttcctctctttcttttctatatacagctctccaaaaacgcagatttctctagatcacagttgttcgtggagaagtgagagtgacaattttagagtaaaaaatttaatattgtgggaattatctctaaccagtcaaattactaatgaagatatttattcttgggaatctagaatcagctatttaagctttctaggatctggagtcacacagacttgagttcacatgatggctctttcacttaccaatcatgagactttgggttaatcactgcatctacttctgaccttcagtttcctcatttgtaaaaggagaatgctacctcatgggactgttttgaggcccaaatactgtatgtaagtgagagggctttataacgtataagttgctctttaaatgttatttaatcattatttagcttctggtttcattctattaataacattttaaagtgttattagaaaaattgtaagattcttgctaatattaaaatatgttgctttatttaaaagtaactcctaattcatgcccacctaataataaagaatatcattaggtggctgtaaacaaaaaaatcaaacagttctttctttcctctatacactcacacacttctggtcatcaaaatgtgtgaatttttccgacagagaccaatactccgacactagctgggtgtcttacaattcaattcagttctgaaactaaccagcattagtgcaggccccatagattaagagctcagtcccacaagtctgccccctccccttcagacatctatctcaagtcccaggttgtcacctgtacttctggctgtaaatcaaggtttccacgaccccctccttgggtttgacaatttgctaggacagctcacagaactcaaggaacacttgcttacatttactggtttattatttaagaaaggatacaataaaggatacagatgaacagccagatgccaaggtacataaggaaaggtatgtggggagggatgcagagcctcttgtcacctccatgtgttcaccaatatggaagcattctaaaccctgtctttttggggttttgtggaggcttcattaggcaggactgattaaatcatttgtcattggtaataattcagtctctctttttatcttttgttttgagacagggtctcaccctatcacctaggctggagtgcagtggcgcgatcacagctcactgcaacgtctgcctcctgggttcaagtaatcgtcccacttccacctcctgagtagctgggaccacaggcgcacggtctca

SEQ ID NO: 139092 - DNA, 1920 bp, Homo sapiens
tggtaagtgtagacacagcctttggagggtaatataaatgagttcaggcagggcatctcttgtaatctgggaacagaggagccagtgaaataaagatgctttctttcaaaaaccaagggaggagtcctagatgaaatgaatcctgaaggctattcttattttgggggctcatcatgaagataataagaatccattttgttgctgaaataaccaaataagagtggcacattcccataggagtgaccattctcttccttttggaaggggcagctttagaaaagtgccattatgcaaagctgaaggccataaaaaagtgccattaaagagaatgcaaattagcatgggcctaccagcctggcaggcattattaatgttggaggtaaagaaattaggttgaaggtatggaagaaccataaaaaaacaaccagaggccagtgtgacattgggctgatggccacttaagctgatgcctcatggctgagactttgctaagtggaagattaactgacaaaacagcttgaaggttgacgaactatttgagctcattgccagatactctagaggcaaaaatacttatttttgtgatttttttttctgaaagtggcacagtatgttctaagagtataataggccagctccagagcattaaagcaatgttgaaatgaagcatattggtgtgaatgatgcatagtaggctatttatgaaaaattacttcaataaaaaacttcatgaacatgtaaacatgattttatgtataaacacactataagatttatgaaagataatcatactaatatgagaatatgaagctgaagcaaggtattttttaaaaattacattgttgaacaaaatggtctgaatatttctgcttttaggtaaggatctatgctttgcagctgcctccttcagtttgtttttatgacttaagcaaataaaaaaaaaagagatcattttagcattagtatagcattctacaatcttctggaagcttttatatttatcgccatatgggtgtacattaaatctgcatctccctctcgtttatatgtttatgaagttataaagatatacacatgcgcacacaaaataattaagcaagtgatgtgtgtttgacaacgattggtgacttaatgccaattagagggtgttaaaaaagaacacttgctttcttaatccaattgttcccatgctttttggtttatgcacttaaggagagaacccatttaaagtgccagaatttgcatacatgcagctttgactgagccttctatttaatccagtggtcttaaaaaattattagtgagggttttagagacctacatgtcatgagatccattaggacgagactgaaagtacactttttggctgcctcctttatgggaaggggtgtgcttttgatatggggagagctaaaggtatgtggatcagctggactgtttaatgcagccagattagctcagctcatctcagttagagcatcttgtgttgcagccaccttgcctaatgccattatgggaaagtggctcataattttccagagttcagctgaatgctaagtgaaaggctacatacagtgttcgtatgtatgaaagttagcagttgcattgacgaactcttctgttttaaaaattctggttggactggaatgggcaggattgtgatattcccctttcaatgtcatgtttgttttgctttaaatcatggtgatgtaaccattattcattgtaggaagattatggcttcagtgtccaaggactgggtgcggggtttcaggttgtgacctttggctgagaatgccttctctagagaatgtcacagaggtcagatttctatgctgactgcaaacaaacctgcgaccacaaaattcagctcttctgatttgctaggatctgactccaggatgcagtactttctggtta

SEQ ID NO: 139093 - DNA, 2063 bp, Homo sapiens
gaatggactgttacagccagtggtcagtactggtcgtgtggttcatcaggctctaagctgttgggctcagttttacttagctgaggatacatttcttcagctgtctttgagagctgtggtaccatcttagctatttcatagaagagggggagaaatctaccattacaatatctgtagaattccagtagtattaattagcatctttgcatggatgtcgaacatggtgttggagtccttacaaagctgtaagttctcaggtagtacaaaaggctattcagaattaacatcacttaataataattttagatcagtgctatggggcaattaaaatgctagagcttgtctttcatggatatcagtcatcaactgaggtagtatgtaatgacattaaaagaatagccatccgtttttttctgtcattcattaagcaagattttgtgaaactgttcattatattccagggaagagacatcattctctgtctcacagagcttatggtagaacagaacaatttagtactttagatatttaattaaaaaatggattttgtttgaaaacaatttgaaaatcaataatgtctttaaaatgtcatacatttaccagaatatacaaaaaatagacaaaagtccatctgttatgttgtagtttgggtctaatcggcaaagcagatggagtaactattatgtctctggcatggtgctagcagttgtggggagattagagccaagaagaaaccaaaaaagccaagataaccatcttcagcctcaagtccataaagattagcatgtgaagtgcaggactatgtcatgtagacaggtgctgggagaggaaatttagattttggacaggcccttttccttcccttggtctcagtgtcttatctataaaattggagatttaaatgacatgctttccagggccctttcctttctaaagtatgaggaacaggccagaaaaaggagacatccttttgagaaggcctctgggagtaggagagttgtattaagaagaaaggaggcattgtgggtgggcacggagtcctcatgaccttttgaggtccagcaacctcacctaggcaggtctggccagacccgaaaggttcatgcttggagtaataatggttagggaagtagatggggttaggctccactgtggaggacttgaatggcaatgaggaaccccagtaagtatgagaagctcttggatggaaagagtgcaaaaacaccatgaaagtaaataaaggtcggagtctaggtaaagctatctccctgatatctagtctggaatgtaggtggtaccagccaccaaaacagagaggttgagaaggggatctggttcgggctggagagtactaagaagtcatgactggttcctgttgcctagatttctagtggacaggacttataaggaggtgacaactggggctctggggcaggttagggctccatcgtacattatatgtgggaatctgtggacccagttaatctgaattcacaattggcgttgttatttaagtgatagctgcaattcacatatgggactcttagccaaggaaaaggatgtttgaataaaggaaaaaagatcaatagttatgattacataagaataagatatgcttatctgtcaaaaaaaagccaaaacgaaaaggtttcaaactggtaataatatgcacaattacaacagacacaaagttgaaatctttactgtacaaagaactctcacgagctgattagagaatcaaaggacatgaccagacaatttacaacataggacccccaactagtttgcagacatggaaaaactgttttatttcactggtactaaagaaatgcacatttaaacatagaatactttttttgcctctctaaccctgattaaaacaaacaaacaaacaaagcaaaacccaacatatatcaccaccaaacaaaaaaagtagacagtgctgacaagggcatggtaaatatcaaaattctcatacattgtcagtgggaatgtaacttgaatgatctttttggaaataaatagtgtaaacacagaatataaaaatatttatttctatgacc

SEQ ID NO: 139094 - DNA, 1053 bp, Homo sapiens
acatccctaaggctttctattcactggggataggttttgtggctagattgcagaggggtctttcattgccatgttgggaatccctgcaaagctgagcaggatgggagcgggctgaggcctggttggatgagcttcagtaggagccttcagctgcgacaggaaccacctactgactcacagccattcatccacattagggaggtatcagaggctattgtggctgcaagccaagactctgaatcctgcttccagtgctacatttgggatgcttctctgcctccgcggatggttaagtgcttgggtgatatataactgctgaatagaaacaaccgtgatcacgttgcctggagaggacaaagagagagagagagagagagcttggctggtgaaaggctcaagttgtttattaagaataatatttctttaaaaaaaatcagaaattggatttcatccatctgtctgccagtatgttgtttgcagtcactcagggtcctgctcattttagaatttctgagaccatttttgaaagtgtatccaaacattgttgctcacaagctgttaaaagtcccaaattctgcaggcttttcttaggccaaatttcctctgtttgtagccaactctagtgtgccatttgttctgtagagggaattcagaactgggcccaaagaaatagcactagcccccttcttcatcactaagtatcatgctggccagcatgcacagaatggggttgagaggtcagggtccatggctatacaagtcaaagaatctgatcatattcatgttgtaccctagacttttagcatctctaaaattttcagtttggatgagtgattgggccgggggtaccacacccattgggagaagaacagatttctacatccctgaggtgttttattcaccaggggtaggtcttgtggctagattgcagaggggcctttcattgccatattgggaatccctgcaaagctgagcaggatgggagcaggctgaggcatctggaagagtaattaattatcatctcaaatccagtagcatatcattgatgggaaa

SEQ ID NO: 139095 - DNA, 1919 bp, Homo sapiens
ctgcttgtgaagtggctcgagctcttaggcgtgaggcattattatataaattcaagctcgctcgtgatccttagtaccctgagttgcctgaaggggggaatggcactgcctgcgtgtgcagtccgggagttcgagccgccgcggcaaccggagcgaggagcgcccgtccgcaccacctgtccccgccggcattccagagtagaggccgaattggcagcgagccggcccgggtcggtcgccgcctcagttcgcgcgggccctcctaggggtgtgtctcacggattccacacccggccgctcctggacaagccccgaaaggcgtcttcttccctggcgggagccgcgtgcgccccgcttttcgcgctgctgtcccggggccgccgcaggcggatgcacgtcctcaggcgacgctgggacctgggctccctctgccgggccctgctcactcggggcctggccgccctgggccactcgctgaagcacgtgctcggtgcgatcttctccaagattttcggccccatggccaggtacgttctaggtgaaagcggggttcgcgctcccaggccagggcgcgaaggtgctgtacggggagggaaggcagccgcggggggtagagaagggcgtaaagttccagctggccattggtggcccggctagggtctccggaggggtgcggcgcgcatttgcccacgccgcggctccgtcgctactgttccgcgggcaccggcagcgcagcgtctccgatagcaagtcgggctgccggccggctcattcccccagggtaactctgagcccccggctccgagctccctcgaggccgcctaccgggtgggcaagcgggcgcgggcgccggcaaaaggagggcttcggggcatgcggggagaaacccggacagaggtgtgcgctccaaagaggataggggcagaagagcccggagagtccggcggacgaagcgggatggggatgggagcgggagccaccgagagtggagcgagacacgcgggggcccggactgggggcgtgagttgaggagtggggcgactgggcccggaggggtcccactggggctaaaccccgtggaggggctccggggagctccggagagctctggcggggggagggggcgaacggcccgcgggaaggagtcggggtgggggtgtgtgtgtgccgcagaagccacagcgctgagcctgccgggaaggaaggaagcggggaagggagccgccgccgcagccgccgccgccgtggagtactcggtgcggaggggagggggagaggggcgcagcagcggctccaggggaagggggcggtgcgggggcacgacgagcgcgggctgagctgcgggattgacgtaacgagcttgggtttcccccagcgtcgggaacatggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggtgagtgcgcgccggtagtcgagcg

SEQ ID NO: 139096 - DNA, 3206 bp, Homo sapiens
gaagataaaaatatcagaattccagaaagattccaaaaagtgtctgaacagactcagcagtgtgacggtatgagaatctgtgaacaagcccctcagcaggcactgcctcaaagctttccaaagccaggcacccaggggcacacaaagaacctcctaagacctacaaaattaaatctacagaagtctaacaggaattccctacttgcactgggttccaataagaatccaagaaacaaagacattttagataagataaaatctaaagccaaggaaacaaaaagaaatgatgataagggagatcatacctaccggctcattagtgttgtcagccatcttgggaagactctaaagtcaggccattatatctgtgatgcctatgactttgagaaacagatctggttcacttacgatgatatgcgggtgttaggtatccaggaggcccagatgcaggaggataggcgttgcactgggtacatcttcttttacatgcataatgagatctttgaagagatgttgaaaagagaagagaatgcccagcttaatagcaaggaggtagaggagacccttcagaaggaataagaggaacgtactcctccttgtacagatctgcctgactgtctcactcgataccacttcctccatggaaggaaaactgtgaactttatccagagatgaaaatgcaattagtctaggaccaaaggtcaaacagaaacacttaatggggagatctgcattctaatcctgacacagacacctcaatcccatagctctggctgatgagcatccttctctcctacaagactgaaattgtgtttttcatgttcttcttcattttaatatagtcagggtcttgctctgtcatcctggctagagtgcagtccttcaataataactcactgcagcctcaaactcctggcatcaagcgattctctctcagcctcctgaaaagagagggacttatcttcttgcttgagatgggactatagatgtgtgccaccaggcctagctatttttttttttttttttgctttttgcagagacagggtctcactatgctgcccaggttggacttgaactcctggcctcaagcaatcttcctgcctctttccatgttctaatacagtggtttaaaaagtatgctccttaaactagcagcaccaggagcatgggggtagtcatttgaaatgcaaaatcttgggttccactgtagacctactgattcagaaacttggggtaagggatagcaatctgatggagaccgtgatgcttgatacagtttgagaaccactactgtactacatacactaccttggttgtatatttaaattgcttattttgtaaaaggttttgattacatttttgtgtttttcatattaatgtatgccttgcctttgtgaacttattaaaagccaaactcacaaaaatcacttctgatcatactctgcaatttggtggaaaaaaatagttgctgggatcctggcaataaaaaatgaggctgataacttttgaatcctcttgggcatatatagatgaggctaaacgccaagtcaaatctccagattgatttgcttttaagaaattggcccacatttcctgtgtgtctgctagcaagctcttggcccttggtggtctgagcccaccttgccatgttagttttcttagaggggcactttcattgcctcagaggaactttgtttacctggacttcatctgcgaaaccttgaacaatcctctgcattcaacattacatgactaattccagattttttttttttttttacatctctgtaccttatagtgtggtggtcttgtttcttcaatgagtaagcaatatatgctttaaagtggacttgtagaatttgaaagtattacttgttacttatttgacacaacatcagaaactccatatgaagatgttctgcttctggggaaagatgcatggatcctagggtggtcatatttcattaaaatccaggggatttaataattttgccatcaagcatgtgccaccactattatcataaccttttcctgcctttgaggcagtgaatctgttgtactttgtgcctttgctgtgaacaaatgacttgtactaagaggttttctcacataacataggattgaattttcagtcacacctttaccaataggaatatgcccccttgtatatggggtatggcttcagtatagttgtattaatccaagagcttgttgatgctcttaagcctagggtcctttaaaataggtgagttggattttagtgatgtggggaagttattagtaggtaataccctgtaagaggaaaaccagattccaaagtttggagattgtattcagaacacagtttatctagaaggaggtcttatgagacctgaagattgctaaggtatataggagggaatatcatagattgaattgatcactcttagggaagaaggtgttacagacacaatgagtgattgttcaacttctgtagtacttcagcagctgaaggataaggctggagttgcatttagaggagagtgacagtttggtttctaaatttcagttttttggcctctagagtagtttatgttgagcccagttacatagatatcagaacaggattttggtaagaatgaaggaaagttgttttgttttgaaaggagtgtgaagatgctaataacttgatattttagtacagagtttacatcctggtcatgctgctcttcagcatgtagcacttccaaatgcagggcaaaatgaaatgtgaagaagatggtaggggtatccatgacagggaggatcatggctgcaatccattgttgccctgtgagaagaaattctgaatgcactatgaatgcttgtatagtatctacatggtatgttttcaaataaaagattaaaagttgttaagtgactcagtgactattatgtatataaatttgttctcttaatttatgggtcaagttttcaagtaatccatggaaataaaagtttgactttcagtgtgttcatttcctattgcttctgtaacatattactacagaagcttataacaacatagttttttaaatcttacagtcctggagattaagagtctaagatgattatcacttggctaaaatgaaggtgtcagcggggctgcaatcttagatgctctgaagacacaatctgtttctttgccttttccagctttctggaagctgcctgcattcctggactca

SEQ ID NO: 139097 - DNA, 1739 bp, Homo sapiens
aatattcaaaatgtagtccttaaatcctatagaggaaaccaaaatcacctgcatttaactttacaaaataataatggcttgtttattgaaggattatcctccacagatgctgaacaattgaagatattcttggacagagttcatcaaaacgaggttcagccacctgtgagacctggtaagggtgggagtgtcttttctagcacaacacagaaggaaatcaacaaaacttcattccacaaagttgatgagaaatcaagtagcaaatcttttgagatagcaaaaggaagtgggacaggtgtccttcagaggatgcctttgcttacatcaaaattgacacttacttgcggagagttatcagaaaatcagcacaagaagaggaaaagaatgctctcatctagctcagagatgaatgaggaattcttgaaagaaaataattctgtagaatacaagaaatccaaggcagattgttcgaggtgtgtaagctataatcgagagaaacaattgaagttaaaagagttagaagagaataagaaattggaatgtgaatcttcatgcatcatgaacgccactggaaatccttacctagatgacattggtcttctccaagctctcactgagaaaatggttttggtatttctgttacaacaagggtatagtgacggttacacaaagtgggataaattaaaactattttttgaattatttccagagaaaatatgccacggcctccccaatttgggaaacacctgttatatgaatgcagtgttacagtctctactttcaatcccatcgtttgctgatgatttacttaatcagagtttcccatggggtaaaattccccttaatgctcttaccatgtgcttggcacggctacttttttttaaagatacctataatatagaaatcaaggagatgttactcttgaatcttaaaaaggccatttcagcagctgcagagatattccatggcaatgcacagaacgatgctcatgagtttttagctcactgtttagatcaactgaaagataacatggaaaaactcaacacaatttggaagcctaaaagtgaatttggggaagataattttcctaaacaggtttttgctgatgatcctgacaccagtgggttttcttgccctgtcattactaattttgagttagagttgttgcactccattgcttgtaaagcttgtggtcaggttattctcaagacagaactgaataattacctctccatcaaccttccccaaagaataaaagcacatccttcatctattcagtctacttttgatcttttttttggagcagaagagcttgagtataaatgtgcaaaatgtgagcacaagacttccgttggagtgcactcattcagtaggctacctagaatccttattgttcacctcaaacgctatagcttgaatgagttttgtgcattaaagaagaatgaccaggaagtcatcatttccaaatatttaaaggtgtcttctcattgcaatgaaggcaccagaccacctcttcccttgagtgaggatggagaaattacagatttccaattattaaaagttattcgaaagatgacttctggaaacatcagtgtatcatggcctgcaacaaaggaatccaaagatatcctggctccacacattggatcagataaggagtctgaacaaaaaaaaggccagacagtctttaaaggggcaagcagaagacagcagcaaaagtaccttggaaaaaattctaa

SEQ ID NO: 139098 - DNA, 1933 bp, Homo sapiens
aggtaaaatgagagaaaagcctgttggctttcataacttttgaatgcagctgtcatctatacgttttgaatctggtgtgggggtgagaaaggaggaggaatgctgaagtttattttaggctgtatggaatagtcacatagtgctcttcaatggagtcttggagaaacaatacattttagtttaaaatactctcaaagcaagcaatcaaggcagaatgaagaacaggatttaagcttgagatgtcttagggatgtaggcagtggttagaccactcaacttgtacatcagcaagatggttcttaacctttactttccatgctcagtgggctcaaataagcctcctttcatctggaatgaaatgtagtcaggatggactgtgagaaaggaatgtctcttaactgtatttttgagggcagagagaagaaatatcaagagggtcttagattatttcatctaccaatagaaagaagataataatttttgataaatacagatgagctgggtgcaaaattttaaaataagctgcaagtggttctatggttgcaggttctctcaagttgttgaaataaaaaggaacaattaagactgccttttctgtggagagaaaattgtttaaatccttacttagcatctatagtaggacagtgaaatagaaataatccagagaacttaaatttgtgctgtgcttgaatgtttttatggccccatttctaccatgaaaaatataaccattctcttacttggatgcatatgcactttcgtatatggatggatgccatctctatttcgctgaacataggttgatagatgaaatactttataaaacaaaaatctcattaatttatgtttcaccaattttaagattttgataatttggacagggactgagcagaagtttccttcagtattattcataaagatggggtttgcttaagcaagttaatagcatagagaagattcaggaagaatatttaactactgaggaggaaacagcttccaactaattcttggatgtatactttctgatgcaaacatttgtagtgctgtctgctaacttattcagtaattcacattggctccagagttgttcagagattctgattttcaataattaagtacatctaattcttcctcactggttttgaatacagggagctagctccggttaagtgggccttatagccagagttgcctgcaggagcctcactagcctatatatctaatgggtaagaagttgttattcttaaacttttgttgaatgagcaagtacaatgtaatgatgttccccagtgccaagtgaaatataggaacatagctagatttggagggaggtagactggtttactttgagtggcccatatatgagatcctctagaaatcaaggaacaattcatctgttactgagttgagggccacatagtgccttcactttctcattcacttattgtagttgccccatggggtcattctgtgacaggaagattagcatattgtatgcatgcacttgagactctattgagtatactttcagttatgtactgaaagtcttccaagtgtttcatgatttcaattgaagttgggaaattaatcagaatggagtccagtattttggtggaaactacatgtagtgtatgagtgtagagtttgagttttgttgaagcaaagcatttctgtaatagtttaaagaatgtttcctgatttttgccatagtgtgcttgtcttgggaatcaagactctgccttcatgcagccatggaaggctctcaaaaggcattggtctcgttactgaagagctggatatctagaacctgaactagactctagtataaaaccaatactagaaataggatcattctgtgtagagaactaatgaactatttctttggtgttgtcttcacagctgaacttgcaaaacagattggaacttcaagatt

SEQ ID NO: 139099 - DNA, 1006 bp, Homo sapiens
gaggaattggcttatccaagatcactaagctaagtgtagtttaaaataaatgtgagttgaagttgttttgcttttcaaaactcttgcttgggattattggagatacccagaaatggttagaaactcatatagtcattacctggctccgtctttccacttactgcattcatgggttggcacaccacctcatgggtacttcatttttattccgtgagatttgcttaggtaacttagcgggatttctcagtatatctttgttctcttcacatgttttcatgaagttgtgaaaaaatgataattaaaacacacaccacctgtaccacactgccatatatcttgaccttaacctattcagtaagataaacacatactcgattttatataattgatgacagtctgtactcatgtcagcagaggagaactgacctagaaatgttagtttctcatagtcattgagcctaacgacccttctagaggttattaatctgcctccaggccatagctccctctaaacttttcaaaacaaatggttctcttcttaaagcatcatccatttcaccaaaatacttgaaagaaaataatttttgtctcgttttcttatttttattactctttggtaatgtacactttgggattgagaaatgcaaattcagatttgaaaggtatatacggatttgtcttcaagttcttctacctcttgaaataatgaaagcctgagtggtgtgagatataaatggaggatacagagggtaaatactccaaaagcaacacaaaccttcattaaattacaggagtcccctcttttattgtgacgattacacagtgatgtttagagtctaaatcatttaggtacagtgaatcctcacatccattgtgtccctgagagcaccggctgcaatacccaacattgagcagatactcagcaaatcataatatgcagacagcatagagtagatgctcagcaactgtctcagtgaacacgaagatcaatgtagagtgaattagt

SEQ ID NO: 139100 - DNA, 2331 bp, Homo sapiens
gaaaataaatttatcctctgatagctattaactttgtggtcgggtaatataagcagcattgcagggtatcacaggcaaagtaacagtcttagaaaaagtgaatgattggtgaattctgaggcaggaaaactcaaacgtgggaatcatcgaaataaagtgtgacttgaactgggtctttagaaattaagaaggatagaactaagacaaaagtaagggaattattagggaattccaggcagagaggaaatgctacaaaaagctaagatagcagaaaatacatggacttttaggtaacactaactgaattttacttttttaattaagacattttccgttgcatggccattgtttgtatttatcttaaaacccgaggtcaggaatattttactgcttcatgtttggatatggaccatagttaatgtccatagttgactaggtatcaacatattttggttagtaagtgaataaacaaatgaattgcaatagttagcagaaagggctgcaaaatactaggaagattccaacaggagaagaaggattaatttcaagaaaacctcatttatcattatttcagtgtaacaaatacatgctttcttatgaaacagcactctttcttaatgaattcatatttaaattttggaaaataatctttgcattctgttttcctaatcaactatgttgtattaatagcactagcataattttaaaagaatgaaaaaaatgctctgccaaatctgtccctcagaaagggttcaaacttgaatagttcatgggaacaatttgctagtctagagaattcttcccattttggtcagggcctcctatggagagatttatgtgcagtgtatgtcaagagacaaaataatggcatttctctgcaacacaatgactcggacgtttgttgagtacagaaatgcacctttaaactagagaaagaaaaagaaagtctgccctgatccaatcattttgaaaagccatgcacactgaagctgggaccaaacataataacaggatttaattgctaatgctctagaggcagtgtgtctcttgatgtgttgacctttaacccaaacttgggagggtaaaaaaaagggaggggaggatttcctttccccttctgcctgctgtccccgactccctgcatctgatcatgtctgtctctaacgcagtctacgtgcccctaacattcaactctccacttccatttccattagttacttccagctttggagccgggatgagaatgaatagaagaacagaaaggaaggtgggaggagaataggagaagaaagtctgcaagcagttgacagctgcttagaatcaggggatggaattgtagctgctgaaatgagagctggacacctactcccctgatgcttctcccctactccgtagtattttgtgatatttaggccttttcatgtgtttctgttcattgttccattccaccctttctgggtccgtacttataatcatttttttctctacaccttcagctcccattttcctcttactcggttacttatgaatggcaaaatttcaagcaagttaaattcaaggctctgcctattacacacctgaaccatggcaactagacagctaaacgtggctggagaaaaaatatgcagattggtcttgctgtaaatatatgactattagcctaagtcagcccttggtgctactcagcaaggttactagtccattcagtctcccgctcttttacaaaacttccacaacttctttctcttcaattcttttaccatgctccagtcatgctggcctgctttctgtttccaacatgccaagtccattcccacctgaggaccttttcatttactcttcctcctgcctggggcaccctacatttaggtatttgttcacttccttcaacaccctgctgcatattgtcatcacgtgttaggccttcccagaaccccctatataaggcagcacatccccatcaccactgacaaattcagttcctctaactttgggtttttgtttgtttgtttggttggttggttggttggttggttggttgggtttttttcttttgcttttttgagacagagtttcgctctgttgcccaggctagagtgcagtggcatgaactcggcgcactgcaacctccgtttcccaggttcaagtgattctcctgcctcagcctcccgagtagctggatataaacagacacaggccaccatgcctggctaatttttgtatttttagtagagacaggatttcgccatgttgaccaggctggtctcaaactcctgacctgaggtgatccatctgcctcagcctccccaaattctgggattacaggcatga

SEQ ID NO: 139101 - DNA, 1498 bp, Homo sapiens
agctattttttttttaatggagcaataatctttgtttgcaatggctttggaagttttttgttttgttttgttttttgttttttgtaacacaggcccaggcttgagtgcaatcacggctcactgccacctcggcctcctgaactgatcctcccacctcagcctcctgagtagctaggactacaggaacatgccaccacacctggctattttttttctatttttcgtagagatggagtcttgctatgttgcccaggttagtctcaaactcctgggctcaagtgattctcccatcttggcctcccaaagtgttgagattacaggcatgagccactgctcccagcaggaagcacttgatatgggacaagccccagccccgcctgtctgctatggcagcgctccttagtcaagtgtcaggacttgcaagcaaagatgtcagtgaagggttagaaataggtttaccagtaaggacaagagagcacagtatagcaggatcagggctggaagttctgctgagcaaagaacgttgtaatgggatgtcagatatgagtaaagttgagggttactctggacagaaagtccaaactaagtaagattacacaaacagtgtgagggaaaaggacctgtgtgtctgggggcttcagtagcccaggaaatcttttagcactggtagctcagttatcattggcctacagtaggcttctaaaacttcctacaatctcacctttctttttacctaatgaaattttaaagcaagtgaatccctgtacagcacagtgcttaaggtgttcccaatccagtaccttctcaaaattctcatcctttttctggtccccccttcaatttgactactttctgatagcttaaaccacctccaccagttccttctctgaatgcttaagcacttattgtctgaatcagtttattgacaccaaactaactctgcccagaaatacttcgtacctttcctggattcctgtcagcactccagatatttgagggaattaaacaaaggccttttttttttcctttcctaactcaagtctagactgtgtgttttttaaggcttcatgttgctttactgtcaaaattggttccaggtcttccctcttactttttgagtatagtgtctagccattcacatgcttagagaataaggattcctagcagtgacaggcactgatactgtacacataaatacaattaatactgtgtcctcaataggtggaagcactccttgcttgccaaaaaagtggcagtttggttttctgttgttgttgacaaacttaaataaatattgagctccttggaggaggggccaagatggctgaatagaaacagtgccagtctgcagctcccagcgagaccaatgcagaaggcaggtgatttctgcatttccaactgaggtgcccagttcatctcacagggactggttaggcagtgggtgcaacccacagagagtgagcagaagcagggtggggcattacttcacccaggaaat

SEQ ID NO: 139102 - DNA, 1044 bp, Homo sapiens
tctctctgtttctctctctctctctctctctctcgtctcacacacactttttaaatggcagcaaagaggaagaagatctggtatgcagaatcagggaccacctaagtagggagatgaatgagaatcacctttttaggggttagaggtatgatttaggttttgggaatccaatcttaaggatatctcaggacaagttttaaaaacaatggacaaattaaggcaactttacaaatctgctcaggagactgatcctttagataagacaaattggtatttttaagccattctgagggattttcattccaatacctgtggcatttaatacattttcaagttcattttccaaacaagcgtctatataaaataccctcacagctcttgctaggtgtatgttacagttctccttaactaagctgaagatgcattgaagaattgctgccctctttaccttggaaatgaaaatgctatagctccctcttgtgtcgtgtgaggccaaacaacccctgattgatccacagcagtggaatctattccattagtgtcccaatagtatctctgcaaggctttttggggatgaggacattgatagaaggataagtaccaaggaatccttgtaggaccaccccaaaacattccagggagacctctgtcatactcctgctttttgaaaaatgaacttacccactactccgtagttggatcaataccttttcctttccagaattggacctgtggtcatggatgttcccaggatgaccttgacccaacaatgattgttggaataatcaatggcaagaagtaactgttttttattattgtgtccggaattggtgggttcttggtctcactgacttcaagaatgaagccgtggacgctcgcggtgagtgttacagttcttaaaggctgcgtgtctggattttgttcctgctgatgttcggatgtgtttggagtttcttccttctggtgggtttgtggtctcgctggctcaggagcgaagctgcagaccttcacggtgagtgttacagctcataaggcggcccgtct

SEQ ID NO: 139103 - DNA, 1839 bp, Homo sapiens
aaggccgttatcacctagattctatgcaatatcaagctataaatggaaacacctggtttaaagtgtgcaaataaccttgggtgatggtgagggggacaaaagacgttagttagaataaaaggaatattagaagtcagagataagagtgctctatgtatttgaattccttctttctttggtcatttatttaagtgggctattttacaaatagtaaatgggaaatgttaaactgctttcttatttatctaaaagtatatgcacacataatctggtttattgctggtattcttgatttcttaacaaaaatttatctggtttgcctgtgctgcctgaagtagacatcattaatcaccttgtggctatagctagaggtgaaagtatttcagaggagtaaacatcatcctctcatacctggccttcatttctaactccctttgtataaggaataaaaccttagcaatgaaaaccaaatacttagcgaccacccactctagtgcattagttagaacatgtccaatattcttgagcattggtctcatttttttcatacaaagaaatttaacctttcacctaactcatttccctggtccattcagtctctgtgtatgtgtctgtgcatgtttttcaagcactcagcaaggaagtaaataactaggataagcatctataggttgagaagatcttggtttcttctagagatgtgctttgttttcacatatccagaagacacaaatggaaattgtgttttttaggaaaatacagcacaggtaatcagtggagaatctgatctgagttcagtccctagctatgaggatgtgtatttgacagtctatgtactgatattgaaagaatatgagggaattagctttgtgcccttgaacaagtaatttacccataggcttatttttctcatttgtaaatgaggagcatgaacaagttttttttgtgacccaagtttcatgattcagtgggaaatatccctggcttagtatttagaagtcattaaatgtgtaacccctccacacacatgaaaaagtacactagaaattgctgaaaacaaccgcagtagaaaatgcccagtacaactcattgtctctttcagtgagaaaattgcaagttccaaaggaaattctcatgaattctgactctcatcaggaggcactgagtaaatcaatgtattattgatcaacctgctctcatgaatcttttctctccatttgtctctttacctatatggtgagtgacatgtccagcagctcctcagagaagtaagcataggtggctcaccaaattccaagggagttgtgcttagtggagcaaaaacaagtggactttaaagaatgcaactgggccaggcgcagtggctcacgcctgtaatccaagcactttgggaggccaaggcgggcagatcatgaggtcaggagatcgagaccatcctggctaacacggtgaaaccccgtctttactaaaaatacaaaaaattagccgggcgtggtggcgggcgcctgtagtcccagctactccggaggctgaggcagaagaatggagtgaacccgggaggcggagcttgcagtgagccgagattgtgccactgcactccagcctgggcgacagagccagactctgtctcaaaaaaaaaaaaaaaatgcaactgttccactatgttgttggctttaaaatagcacctgctccagggtatgaaggttctgtcacatgtgctctcatgtgttcagtcaaaggcatgaaaaagtaaaatccacgaaggaataattatgaaaatagggatatacaaacaatcaaagccaaatccccttcaatggctccaaagtcaaaccccaa

SEQ ID NO: 139104 - DNA, 5597 bp, Homo sapiens
tagatcactgcaggaccctgattataccccttttgcttattatattctgtggattatttccacgtagagaaaacaagtctcactggaacaaaataatcatactcactcccaacccaaaagggcattacctctgttacagactgaattgtattttcctgcaaaatttatattttgaagctctaacccccaatacgactgtatttggagataaagcttttaggaggtaattaaagttaaatgaagtcataaaggtaggcttctaatctgatagaattggtggccttacaaggagagatctctttctcttcccatacgtacatacacaccaagaaaaggccacaagaagacaaatgaccacatctgcaagtcaggaagagaggcctcaccagaaacaaaaccttgctggactttttcttggactttgcagcctccagaactgtgtgaacatacgtttctgttgtttaggcaacccagtctttggtatctgttatggcaacctgagctgactatgacatcttccatctttttctctagccctggaggatcattagaggcaatagctactgagtattgcctacatgtaaaggacaaataaattccctcagtggaagcttggtgtttacatgtttaaagggcagtttggcttgtctctttgtctctttgtgttttaatagcagaatggcatttcacgtaataatttaactccatggctgactctaatctgggtctgccaatgggggtttgcattccttgcttgtgatttccatcacctgacacctaatgtaatgatttccactgcaagggccatctctgtgtctatgaagctctaatctcattggcaaccttgtgatagctgggatatcctattcaatcaggaaactagtgctgtgtataattaactacatcccttccccaaccccagcaactgttatacatcacttcccctaaaactaagtgaaagaaatatttttcccacttccttttcagtaagtgcagacagccactttaagctttttttgtcattcaaagtattcatcatgagcatgtatctgttgaaaatttcagatgcattcttttaaggatgtcattagtacctgagctccctcactagctactgtacttcaggtcagtcattgtaactggagttccagccatctgcatttaagcagcagccatctctgtgattgtcctctaggactacaatagatctttaagctgataaatagtacatgtaattttactgtcaacactgcagttcattggcagtacctaagaaccagttattctgtaagttaggctgattcaatagccttatggggtaataggatatgggactgggatcttgagggcagggtttgctatgattatttaggttgtatcgttaggcattattacaccaaataatttatccaagtggatggtcttcaattttcaagtcactcagattttgagtgactgataaattaagagaatgaggttcattttggggagtgagaagaaaaaaagtacatcagaagcttggaaagggccagaatcttaaaaccagctaagcccataatgcattccagcgaattgttaagatgctattattatgttaagaagtcctctgctttcctataaaggtctctgagagtattttctgttggccattaagcagagctaggcaaaccagacagcaaatgtgacttgaatgctcagtgctgtaaaactattatgtgaatccatttcagtttaggtatggaagatgatggtgcctcagtgctgtttgcatcattaaaactcaggagggaaaatgtaaagtgagtggaaaagaggaaggtaaaataattaattggagctgtaagaccaatgacactcccacccggtcaaaccccatctatagttaaagaattaaatgctgtctagaggactctgaatgagtcacttcttgagaatctctgaaaggctgttaaccttttgcccgtatgtaggaagcataacccctagaacatattctgactgtaaggactagaaaatagaaatcaggattaggcagacattcttagagcttatccaggagagtttagttactgaaacaacaaatatcctcattacccaaactctcctctctagcccagcacaactccttgtactttctgacttttctgttgcttcccatctctggaatgtgccctcccagcctttcacttaatgagtaaaaaggcttagcccaatgctaaggtagactggaaaaaggagactgtacttaagtaggtactttttctagtcttggttcaaacacttaaaacctctctgacctgaatttacctatctgacaaacttggttgtgaaactagggatctcttatatcccatcatcaccaagaattcttaaatccctacatttaccaacctaagagatctccctgctttgtggcccgttgccgtgcaggatttacttacgtctagaaaagaacattaacttggctcctgagttttcacattaaaaaattaatcctatactctttgcttgtctcaggtatgaatctgttttataccagcagggaatattagccctctatactttttttttccttttttttttttttttaaaaaagagtctcactctgttgcccagactggagtgcagtggtacaatctcagctcactgcaacttctgtctctcaggttcaagtgattctcctgcctcagcctcctgagtagctgggattacaggcatgcaccaccgtgcctggataatttttgtattttcaatagagacagggtttcaccgtgttgcccagactggtctcaaacttctgacctcaagtaatccacccgccttggcctcccaaagtgctgggattataggtgtgagcaaccacgccagccctctgtactttttctattcatattttaagaagacatgagctcatattatactcatggttaatatcctgctttcttaacattatacttatgtcatgggcttcttagaataaccgtatattctgaaatgagtactgtagacatggtatatgagtggggtcacttttgattgaaggtgtcagaaaaacaattcgaagtggcttttaagtaagggaatttatggcatgttactgggaaattatttggtgacacttagtttcacatatagtattttctttctttttcccagccctgctttctctggttctctgagtcttggctctttcctcacacaggaagatgccttttccatgtggcaataggagacagctaccagtcctctcacccccctccccatctacattataaggagagaccttcaaactggaagggagatctcattttccccacatggcttggatgccctgttgtcccatgatgggcaggcagcgctctgattgtctgctgactaacaaaatcaacagcagtctactatattctattcctactctgctcagcaatcttcagactctccctgaaatgcacatggcagtcccactgcttttcctgggactttttgttaaacaacttcctggctggaatcacaaacacactcattctctttccaactgaaaataaccaaaagacaatcaagttgatgttttcagtgatatctgtggaggaacttctttccagaattgtggaatcagttatgtgaatagactttaataggaataaaaatccaattttacttttttttccaccttttcggtagtcacaaacacattcactccctttcccgcattttaaagtgtttcttcaaatggttttaaagccctgtaaacattgagacccacttaaatgccatttgtgatctgaatgtcaagtccccatttccacccaagtggtgctgcctgaactctctaagtgtgtaactgattgtctactgtaatctctcttgaattcagactccactatcgtaagtcaatttttcaccttttatctctggggccacatcttggactcagtaaattccacattctcgtgactttggactacatccataaggatattaactgctattgcaccattcttcatgcttttctactgccttttactgatattgatcactcttttctacagtttgatctctattgtttgtcagtgcatcattatctgtcaaaatcccatctacgtcatactataagcaaaccttgaatgtaaaatagagacttaaacagaacatcagttaggaagccattcactgcaaggaactctagcgacttaagtaggagtttaattattttaattgtttcacataacaactgtatcttgggcggtcaaaatttctatttaaggcttcttccctatatgaatatggaattaatgattaaaactaagtacagaatcatttaggcatgtttgactttgaagtaacaaaaatttttactgcatgtaaccccaactacaggctcttaatcaaataagagtttgtttaactgtcatatcacagaaaatgtgatggtagtaaattcagtccttgtgtagtagctagctccacatcattaaggatcaatgctcttgtgatctttcattttaccttgccatcctgcacttgctagctttccaattcaactaatctaaaatgacttttcttctcaacttttagtcttaaacctcatggtattccatatccggtggtcctgggctttcaactgcaagtaacaaaacacagctacaatagcttaaataagtagggtggttattgcagtggctcaatggcatcttcaaggaacaatgttcttaaatctttttacttttcaattctggttgtatttcatcttcatatttcttgtctcatgagcctaggaaggcttccttactccagtcatcttctttatacttgtctcatggtgctttatttccttattccagctgtcatatatgtattcagccagtgaaaagggaaaaagtgaatgtcaaatggcaaaatgggtccttctaaacgtgtctgtctttatcaggccaacaaactcagtagacttctgctgttggttgacagctgtgtcatatgtcctccatatcctagaaaggggattggaaagggaaatgctgtgcatgggggtttgggtcagcaaacctctagtacctgccaaacggaattagatatcacaatagattttccagaactgtcaaggtattaagctatgcctagagtcaccttattttatagatcttagatctgtactgtcaaatatgatagctactagctacttgcaactatttaaattaaaaattaaataaaattcaggttcctactctcattagtcatattcaagcattcagtaaccacatatggcttgtggctaccatattaacagtgtggatatagtacttttctgtcactgtgaagtgttctgttgcacagtgctgtagtagataaaatagggtcagtgaaggaacatagttaatttacagttctcagagcttgctagcagcagagcagacactaagcacgtggtcttctgatgtttgatcaacattcttttaagtagataacatggcttcttaaacatttctgtcctcctgcttaatattattgcttctttttttaaaaaaaaattatacctttatagtttattctatcctctagtgaatatgattagctaaaagtatatgagcaatttgtgg

SEQ ID NO: 139105 - DNA, 2520 bp, Homo sapiens
ccctggagcttaaatatgtcagccaataataattaaataccacccaaacactcacaattttctgagaagagaaaattagctggttttaatatgactggaagataaatcagaccatcaacattcaatcattcatatgagaaatttatataactcacattaaacacatcagatcaactggaaaattagagtaattaaatgttagaggggaatgaattttgttagaagagcaacaaagaattgacatgctgagagtgctgcaaagaccacatcctaaagactctcgagaaaatgcagacatacaagactggagggtatcatgaatgaacagattccctggagttcttaggagtaaacaggaggagtccaaggtgtccagattcttaataggtggatggctagacctggaatataacagcacactggagaagaggacagaaataccataaaggttgactttactccatttatctaaattaaaagccttttgaagttaaaaaaatataaatgtcttcaaatgtacagatgggtttctgataaagatcaacagccttctctccaatgtttctctatccccttctaccctcttcatatttgttttaaattcttctggctatttctctgtctccatatactagcttgaccattatttaaatttttatcttaggagatcctctatcgtcttttgctgtaatagttcatgtgccctaccctcatctttcctcttgtctcttctgccaaaatgtatgtcactactaagttctctgttcgttgcttctgcaacttcagccactgtacttcaacttccatctcttcttgggtcaagactccatgcttacaaggacatttattttgcaattctctccttcctttcacttctgtccctttcacattctgccctctgccctttacttttacatttcatggttgtcaagagcactctttcttttttatgaccctcttattttgttggagaaaatcattaagtaaactcctaggaaacgtgtgtgtgaggcagtttctgaattgttgactttttgaaaatatatttatttagacctcacatttgattgatagaattcgaagttcaaacccataagcctatggttattttctttcctctgttttcttttttctatctttgtggatcttttattactcagatattgtgtctcctggaccagtcctctgtaatatttatatttcttatatgtgtctctttgacatttcacctttattttctgggaatacattcccaagattgtgagactcatacttcactggacacctttttttaggctgcagtgcactccccaccacctccattccctgggtctttctgggtcccattcttctctcttaagcttctcattcataattgtgactccaaccatgatgttagtagacaaagaagtttttgtttctaatccttagatttgttctctaacaaataaaagatattcgttttcctttcctctctgtcgtcctccttaatttctcatgaaaatgcaccttctccttctcttggaatgccattatgcaatgtaaggcacaattaaagacttccttataattgtcaaaatatcacgtaattgcctttcacaatgccagacttgggctttgagtagaatttatcatgtgaactgtgctacaactgatttttataccattttctctgtaattggagtaaataaaagtagtataagggtcatacattattaaatgagccattaaaaaacatctcgaataacaaatggaagaagaggacatgttacttgcgtaggagtctccctatcagaaaattatgaatttttaaatctacagtaagcactctattgatatgagttaataattagctcattcttaattagcggaacacctccaaaataaccgccttgataatccaaattgtttttgcttattatatataaagaagtaatttaatttaagcactgcatctaactttacatcttgaaatatattgcattcctcttgttccacaagttctttagaattttcctgcaatgttgtgttttgtgctgattggaatctccagataatggactcatccagccacttacttgctgcaagattcctggcacacttagctctaagcatttctcttgctgggtaattgaccaaagccttctgcctacaggcaatgggtaaatgaaaaaatttcccaccattacttaaactgtcttgggatgctgaaagcaagattgagagaagggtgaggcttctgattttagagcttcgtcttagaatttagagctagaaagcaccgcttatttttcagagtgtaatactattttatattttattttttaacatttcttcttgatattttattttctctttccaacttttaggttcaggaggtatatgtgcaggtttgttacatgggtaaattgagtgttgtggaggttttgtgtacagattacttaatcatccaggtaattagcatagtaatcaataggtagttttttgatcctcaccctccttcctccctctaccctcaag

SEQ ID NO: 139106 - DNA, 1010 bp, Homo sapiens
aagtcccttataatgttttatttactcagtcttattctaggcaatgaagggaatgcacagtccaagcatccaataaggtaggacagtgcccagaaccaggcaaacgaaataaacaaagagaaaaatgctctcactaggtaatctgaagaccaaacatttaggcaaaaaactgtgtcacattggtacaagtgtactgcagcaccaagcctgcttctatatatggcatttgatattagaataataattaattatgttgttaatccttttggactattgcatggttgttttactttattgttgggttgcttttaaagtttttttttttaattgaatctttttcaacctaatatttaatgagttgagttactgtttctggactgtaagaggtgggaggagatatatcctgtgtgaggaagctatgagtggtatttcacacaaatcctttcaaataaatcagatttaaagtgtttatgttattataggctgtactgaaaacatttcaaaagctcttagtaaacttgtccctaggctgcttatgtctgcatttattcagctttcagatgttcatttgctcatgttgggggtgtgtttgttttagtttttatccagtaccatttatttatgtattattattattattatttttgtgatggagtttcactcgtttcccagcctggagtgcagtggtgcaatctcagctcactgcaacatccgcctcctgggttcaagcaattctcctgccttaacctctccagtagctaggaccacaggggcgtgccaccatgcctggctaatttttgtatttttaatagagatggcgtttcaccatgttggccaggctggtcccgaactcctgatctcaggtgatcctcccgcctcagcctcccaaattgctgggattacaggagtgagccaccacacccggccaccatttaattttatagtcaaggtttgtataactgaggcttcaagctgtatcaggatgtccaaataggttcattaattctgga

SEQ ID NO: 139107 - DNA, 2485 bp, Homo sapiens
atgttaatgtagttcaaggctactaaacagatgcatgcacatacatgtacacatggttgtaatgttgattattttgcaagatcaggaaaggaatggctgtttgttgtgccacatacaattttctttcctgagtatgcaaatgagaccagctacttcttaatctaagcttctcagagttgtttttctgagggatctgcttatgtgtgtgcagtgtgtgtctgtatgtttgattcctcaacggagtattcaaagaactattccagtgcactctggaagtgaaaaaagcacagggtacatagaggttaagaagttacatacatgtaaagaaaggacatcacatctaatactgagaaatgaacacacaggaccatatatgttctctttcatattgaattcctgataagatgagctaggccacgttcaagggcttcccagaactcttccctaatacttagtccacagtctgatactggcaaagccagaagggctcttggggatcacttcccaatgtttcagtaaagaagtggcctttagtgggataaaggccacccagattgtgattgagctgagaccaaagtcttgcctcctgctatatgttgttggttccattccactgtgcaccttccctctctggagaactcaaaactcaaacttccaggaagttgatagttataaaggcagtacattatctctttttttcagatggaggaatggaactatagtgaaatgatttatctacagtcacaaggccagatatgggactaggtcaggaatctcggtgaccatgctctggccacacctctgtttaataactgcatcaatatttaggaagaaatgtcatgcaactaagtggtgaatgttattacttagactaactaatatgtattgcatgagacatttggtcattagaaaggctttgccatccttctggaattcaaagtcatacagggtttcttgaatgcttatttccagagctagactggggttagggttgaggtattaggggtagaaggggagagtggtgtgagcatgcatagttgaagttaataggggtttagctgtccagcagcttctaagcatataataaacgtgctttgtaagagtgaaattcataggtagaaagtagtaagcgctacctttgaggtctggacctggatctaaggctttatatcagcattcaagtgtttctataaggtataggcacaagggagtttcttaggcacttattttctgtgaagttggagaactcattgggcaaaataagaaataaatagaaccattagatgtccttggagaaaagtggtttttttttttttttttttttagtcccatgaaacagctttggacaaccgtcatctctagctccatgaactcagcaaataagcatggagttctattatattaatagagtagattgaggacatttaataactcattattttgcttatatattgaaatgagtaatgagagtgaagtacaaagccaatgttaactctgtgaatggagtactggttttctacttaataaaagctacaattagtatgaatgttgttgtacactgattgccaactgccttggagtgcatatcacccccgtttattgcaatttctttgacattattccatttgaattatttatcctagttttaaagggactctacgaaaaaatgcaataaatgcttataatactttttcagaaaactgtattccaaatcattttataaagcagtgtgaaaacagtaaaacagttatgaaccaagttggctgtctattgttctggctgattgtccaattcaggccagtctgtgttcacaggctgtcaagtgctatgaaagggtctcctcaagagggtaggaggtcagcccatgtgacctataaggtttcttccagctcttgagtatacaatttggtgaaaagctaaactggtggtagacaggatacaaaccatctgcaaatgtcatttaaagtgttttggattttttttcttagagcttataaggaccaaaattcttgccaaaaggcacagcttataccttcctgtttatgatagccattattcatttgttcacatgatttgaaataatagtgttatgttcaaatgcacagtgctatcactttaaaatgtagtaaatttttctttacatgccatttacagaatgctctgtcatacttaaccattgtgttattgaagggtgaaggcagtcaaggactttatagaggtcctatatatgtgaatgtatatatttgaaatggctgagtagagagttaaaggatacgtgatagcgtgcctgtttgtgggtaatacttttcctcatctggtgcattttcgtgtgccgtgcatgcgcatgcatacacacatgcacacagaacagggttatcatagcaggttataccatctgtaaggccaagagttctgtttgtagggctgcatttttatttgttctaaagtagtgattcttaacattttctttgatcacagatcaatt

SEQ ID NO: 139108 - DNA, 1226 bp, Homo sapiens
gggaggctgaggcaggagaatcgcttgaacctgggaggcagaggttgccatgagccgagatcgcaccactgcaccccagcctgggcgacagggtgaggttccatctcaaaaaaaaaaaaaaaaaaagaagttctgccccaggccaggcccggtggcttacgcctgtaatcccagcactttgggcagccaaggcaggaggatagcttcagcacagcagtttgagaccagcctgggcaatgtggctagaccccatctctacaaaaaattttaaaaaattagctgggggtggtgtcacgcctgtagtcccagcagcttgggaggctgaggtgggaggatcacttgagcctgggaggttaaggctgcagtaagctgtgatcacaccactgccctccagcctgggtgacagagtgacactaaataaataaataaacaaacaaactaaataaataaataagaagttgtgctcaaggcctagaagaagctgatgagagtgctgtactgtggctggatcaggcagaatcttcaggccattggagtggagtactgcataagcactctggatagccacaagtacttcaggagagcctcatactgccagatttctcaaatagaagacctgtgagctttggcttgagctcttctcccagagtcaggatagaggctctgctctccttgcatgggtccttctggtgatatagtgattgatgacggggcaaggacttcagtagaagggacagggaaagatgggaactggaagcatggtgggaagagagcaagaagaagtatttatagtacacaaaggagtatgtataaactgctgcttagagcaacttcttttttcccctaattttgacctcttcccaacagattccctgtttctgctttaacctgggctgcttgctaagtgcttgcctctcaggatccttgtggaggtaaggatatatataagtcacagaggagaattattttaaaaatatgtattattttgactcacaaaacaaaatggatgcagatgaaggttttcacagcctatatgagtgttaattagaaccaattagaggccttgtccatcaaaggtgcttatttaattcaaatatgtacacaaagaaactgggccttatcaactaaatccatagctggcaccaagccatcaggaaacccacaacccaacaagtcctgtttccttggatttttgatcaaaacgaagtcaccctacacgcctggtc

SEQ ID NO: 139109 - DNA, 1116 bp, Homo sapiens
tcaagcaatcctctcaccttagtctcacaaagttctgggattacaagtgtgagccaccatacctggccttgaaattttcacgttctataaattcttggtgtgacttcctctctccacactcatgttttcatgcttgtttatatgggtacaggagagagattaaattatagcagaaattttagggcaaggctatttgggtttatagatcttttatggagaaaaacatatttttcttaatacttcatgaaaacgtgctatacacacaaagattaatttgctcaaatttcattttctttaaaagtaacctcaaattataattttatgtgttcacaaggaaagtctagagactacaaaaagtggtatgctttttgtttaacaagtgactctccaaaagaagagaaaaaacctgatatgtggcatttgtcaatttctaaggtgtaaataattccaccatcaccaatttcaagtgttgtcacactgaatgcagattttggaagagatgtgcacttaccacctcatatgagccagctcttacacaacactgaataaattaaaaaattactggcaatcaaactgcatagaattatgaccactgctaacattttaatgttcttctaactaatctttctatgaaaaatatccatatttgttctagtgaggagtctttatattgaattttagtaagtacagtaagtcctcacttaatgtcttcaataagttccagtgaactgcaacttttgaagcaaaatgacttatgacaaaaccaaatttaccattggctgattgatataagcaagagttaggtctccatggcgtatatttctggtcatgaaaacatcaccaaacttctaaataaagactgaaaacacttttactattaaacactgaaataaaggtgagctatctatacctttaagaaaggttaacaaaaacaagatacaataattacccagctcttggtgaatcagtgagtcgtggtggtcattgtggtggtgggtttatttgtttttattattgttaccttttttttttttttttttttgaggcagagtctctctctgtcaccgacactgaagtgcagtggtgtgatctcggctcactgcaaactccgcctcc

SEQ ID NO: 139110 - DNA, 1278 bp, Homo sapiens
taactagcagtcctagaaatttctttcctcgcctgtaaaaagtcacatttgggttgtgattagttcactgaagattaggtgaagacacttgacaacgtaagaaatggaggattaaatgctaaatataaatatgcactatcctaagagtatcttttaacctttagtctcagtagatacctgtgattcctctacttttctgttagcacatattttattctggtagcatcatgtaatctgaagttcacccaaccaaggtaaaaaaaaaaaatcctcatttcttttttttagaaactaaagtgtctgttacatagcacattgacatttcaaagccttttgatttatccctgtaaatggctaaattactttaaaccatggaaggtggaaatcattgttgttatttcctgtccagtaaaaactggggccagagttatttagaaaaaaaaaaaaaaactctacctaaaaccacttaatggagctttgccaccaagttccttcatcaagtggtctgatagtgaccttagctcgtttgctagatgaaaaaaagagtgaatcctaactataactgtgacaccttctccttttgcacacacttgttctacccactgctcttcacagtcatcttgggtctcttctttggtagtttctctaagtattggcatttaaaaagtaagtcacaaggtagaggaatccaaaagggttaatctctgtttgggcagataagcccaagaggtagaaacctaggaaaggtgaaagtgaccctattcagaacttaaagtgggacctggcttcttgattcctaagaggtccagtcctttgccctttaactcaggggtttccaaactccgggccgtggactggtactgggcggtggcctgttaggaaccgggccacacagtgagaggtaagcagccgggcgagcaaacattaccacctgagctccacctcctgtcagctcagcagcggtattagattttcataggagcatgaaccctattgtaaactgcacatgcaagggatctaggttgcacactccttatgagaatctaatgtcttatgatcctgaggtggatccaattttatcccgaaaccatccctccacccccggtctgtggaaaatttgtcttccacaaaactgatccctggtaccaacaaggttggggactgctgctttaactcatctggggtctactctgtcaatggctactaattgaaagaaaaaattttgagacagggtctcactctgtcacccaggctggagtgcagtggcatgatcatggt

SEQ ID NO: 139111 - DNA, 2070 bp, Homo sapiens
ccaaccaaccattttcagaagtttctctgaataagtggaaaaggaagtgttccccagccatccaccaaaatgagttccaagttatgtaattttcctgcagtggtgctgggctgtccatccacaggcaagtctcttggcagattcatacagtcaccatctccttcagaacctgtgatggaaaagtccagtaccagtgagcctatggttctgtaatgtgaaaaagatggaattggaatcaattgtcaagatcacctagacaagttcagggtgtccttacattgtgtgaggtgactagtgtcttatgaagggcagccccctcctcctgtcccctgtgcatcattaatgatggcattgaaaccccttcctagagttctagagatagggactaccaacagtggtagtcactcttcctaagtactgctgactccatgatactgactctgtttctacaacctgttcctttcattagacaggggcatatttttctacttcttaattgtgttcctcatgtacactgtgggtgccgctgttacagagacattgacaaacttagactgttctgatttcaaataaacctgattttgactttttaacaccaaagttctgatctttatttctattttttggaaaaccagtaagagacagcagcaggagggactggactggattgtagaaaacttcaagagttaaggagtgcggagtgctgctcaggtgcctttgtttcaggtatgagaatatgggtctgaaggtaatttgaaagccagccttatatatacaaggagggaaaagataggtcctgaggaccaagtaggtgtcagggaatggtagtctgccagcctgctccacttgtgacatttatttgctagggttcctgaaggtatacgccagcaattaaagtaatatgtaggttattactccttcagatgtttactgttccatacattgttgtccatttccttgctctgcagacattgctggtatgacaaggttccagtttctgagtctgaaagacactgggctcattttcactctaaggcagtagtctggcagctcagctggtttctaacatagtattttcacactttgtgacactgttaaaaattgtcaatgaattcaggcattggaagctggggacaaagatttggggtttgcatgctaaggctccctaagccttgtgtttcctgtcttgttacacaaaagaagtacagtgggatgaatgaatttgggtaaatagatcatgacaaaaagtgctaatgttatttgggttatgttgaatgctcccatataataaatgctctctcttgtgcctgtccaggtcatagtctctgttctatatagcagccaaccacaagggttgattggtaagcattcctgcatctgtgctgttccccctagattgctatctgatatgtttgtttcaaacatgtggagatcctgtgtctgaacttgatttcaccattgctgtcaattttcaggcaaggtatacagtaactgggtcaaaattcctttctgatgaatgatagaatttcatatcaatttgggattcaagctttcagtacatgggaataccaaaccttagagtggggatcttctaaccaaagtttacacttctggagttgttgcctgctatggcatatgttctggaatgtggtctttccctgtagccatttaacagtaagccttatgatttgtacttattaataacatctgtagagtaaatgcctgaattatgtagttttcactcttggtgctttgtaaatttcctcttggattgcttttgagtcagacagacctcagtttaagcctgatttaccagtaactaactttctttcttttttttttcttgagacagagtctcactctgttacccaagctggagtgtagtgatgcaatcacagctcactgcagccttgacctcctgaactcaagtgatcctcccacctcagcctcctaactggggctacaggtatgtcactatgctcagctaattttttattttttgtagaactcctggctgttctcaaactccttggctcaagtgatcctccaacttcagccttctgagtaaat

SEQ ID NO: 139112 - DNA, 3409 bp, Homo sapiens
caagaaagattagagttcattaggaattaaagaacttccatctaattttgcttagtggaaatactagaatctagcagaagtatttgataacctcttgtataatcttcataatcttcacgcctgtaatcccagcactttgggaggcagacagataaaatcttttcgctttacgaatcatcttactggggtcattttacattccaggtacctgtttgcagtgacaggaaatggattagccaaccagggcaacaacccagaggtccaggttgacaccagcaaaccagacatactgatccttcgtcaaatcatggctcttcgagtgatgaccagcaagatgaagaatgcatacaatgggaacgacgtggacttctttgatatcagtaagcatttgtggtttgaaagtacgaattgctcttgtatgtcttctgatgagaacaagtggaatgaaatttctattccatttttttttaaactaggtgatgaaagtagtggagaaggaagtggaagtggctgtgagtatcagcagtgcccttcagagtttgactacaatgccactgaccatgctgggaagagtgccaatgagaaagccgacagtgctggtgtccgtcctggggcacaggcctacctcctcactgtcttctgcatcttgttcctggttatgcagagagagtggagataattctcaaactctgagaaaaagtgttcatcaaaaagttaaaaggcaccagttatcacttttctaccatcctagtgactttgctttttaaatgaatggacaacaatgtacagtttttactatgtggccactggtttaagaagtgctgactttgttttctcattcagttttgggaggaaaagggactgtgcattgagttggttcctgctcccccaaaccatgttaaacgtggctaacagtgtaggtacagaactatagttagttgtgcatttgtgattttatcactctattatttgtttgtatgtttttttctcatttcgtttgtgggtttttttttccaactgtgatctcgccttgtttcttacaagcaaaccagggtcccttcttggcacgtaacatgtacgtatttctgaaatattaaatagctgtacagaagcaggttttatttatcatgttatcttattaaaagaaaaagcccaaaaagcagtaaaatttccatttctccctgttattttagttgccttatctggagagacgtggaggtgattttcttttttttaaattattattaagacagaatgtgagggcacaagcaggcttctgagccacttgtcagattgtattcaaagcatcaatccaagaaggaggttatgtgtacttcatttattggtgatagttggaagagactgcagactactgctttgaatgagttgaattacataagctaagatcactataggtccatttcttgaacccacttatacataaaatgtaacccatttagaaaaagattctggatatcatcccccttgaaagatagaaagcattcaggatgtcccagttatcacatgttcacacttgggtttaggggtgtttttttttaaaaccaggcaggttagctagcccaccctgtgctagttttcatgttcacactgaccctatttgaattaatatcctttgttagagtggtcgagatttcaaacccaattatgtacagggagctgtctgagagctagccagaactggggtacagcctgggctcagggaatagctgtcaacactcgggcaaagtttttgtctgtgcatgtgtatctccatttgttttgggatcccagtttttgttttaagagagtataaggtgtctcatttgagtctttttcttacctagccccctcttatcagtaaaacaaaggacttgccatggttcacagcaatgtgctacgatccaagatatcagccaaggagcccacttaggggagaactaggtgtccagatttttgtatgtgttgtttttcttgggggatggggtggggtgggagtaggtagagctgagaatactacatcttagtggtgacctttagccacgtgggtgaagtggcaaaggccatggccatatctgttgtcccaggccaaagactaacaactgccttgggaatcccttccttgtgtccttaccaaatgatagctcataaaactctgataatgtaacaaatcactttcaaaggagttcccagaagtcttcagaaagactaaaattctgtctcttcctgctttagacagccattaagatcccaactaattttaccgaacctaaaacccacaaagaggttgtttgtgttattgttcaatcttcagttgtaagagtaattctctatttttatattgaaacataattacttgatagctcagggtctacatttcattcaactttttacaccaaattctgcagagtggtcaaaatggaatattgggggctgttgtaaacagaggcttaattttattagaagtagccagttatttattaaagcatgatgttaataaaataggcatattctggctggtgtgtataagtggttttttttttaaaacaaatcagaagacataaaattgaaaaggcactccatttatatataagggaaaatagattgtaaatagctaaggggccttgtgagaacttggaaaatgtgctgatacttagtaactacctcagttgtgaggaatttcctttttagcttagactgctattacttttacttggtagaaatgaatctggtctccaaaatatggctcagagagttatccccatagaccttgttagattgtttttaatttaaaaccttgaactctgcccagctgttttcttccagtcaaattctctaaaccaataacattttccaaattaagtattcttgaaggttcttctgaactcttactgatttgttttctttctttgcattttttcctgttactcttttattatttaaattgtctcttgcttttgaacttcaactatgaaataaacaaatcatagatttttccattcaggtctgactggataactcttggcttctaagcagctggcaagctcacccccactccccaaaaaagaagaaaggcaagttgaatattttaaaaccttaagagtttggagtatgaagtagaataaaagccttgttaggagaagacctgacttttccaaagttaacagcatgtgaagggcttgtgttttacaaagtcatttataaattatttttctttaaaacacatcacctactctgtaccttaaagattttacaactcttagatttatattttatttcaaaaatcgtaactagcacctgttattttgattaaaagacactgcgaagaattgacgtaaatttctaaagtttagttactgagtgttcaaaacctaacagttcacatgaagtaaaaattgtcatttgtgattac

SEQ ID NO: 139113 - DNA, 1050 bp, Homo sapiens
gtaatatgctacaaaaatgtaagaaactattcctacagtagtaggaacacagaagagggagcctgaggagacagggatggagagaaagagcaatagcagctatgtttcacagagtgcataatatacatgcttgatcctgactctaaaagccttaggagaagagactgcatgttatctttgtgcctacagggcatggagactggtaggcctcagatggtacttacaatgaggtgggcaaggggtctaggccactcctttggagcttgcatttcaactattatttgagtggttttgtacttctaagatataaattggagttgcatcttcctcttctaattaaagttgaaaatgaattgcatatcactctggagatactttggaaatggccagaaggcacacttgtaggtagttttgtcttgtcttacaatgatctttttttgttgttgttgtttcataattaggttactgatgtcaaggagaaactgaaacaggccaagaaattctggtcctcccttccgagcaacgtttgcaacgatgagaggatggctgcaggaaacggcaatgaggatgactgttggaatgggaaaggcaaaagcaggttagtgtctgttgaatgaatttgaagtttctcccttcctagatgcctgggtgaccttcagagagggttctctcaattgtcaaccgaggcatcaggaagcaattcacagtaggtagcaacaacatggaaggcttctaggtgttcttaggaacaggctttgcactaggagtgttgagaaggcacccagttacttacaaagagtgctgagtcaaaagtttgacagtagttatagtctcgtattagggctgttccaatagtgtcattatttttaaaatatttaatgcctgtggctctttgtccaatggcctagcctcataaataaccagttctcaaaggttccattctctgacttgatgccctgtgtccctcccttagacgctcagtaacttagagaagtacccatacttttttttgtttgcttgtttgagatggagtctcgctcttttgcccaa

SEQ ID NO: 139114 - DNA, 1044 bp, Homo sapiens
ggtttatgtttcctttcagtctttcacaaacacattagtgatctggccattccttgccactaggggaataaggagttacaaaatgcactgggttttgttgttgttgttgttgttgttatttaaacgtctgcattttagatgtttattttctgtctattcataatatttttattgggagcaggtgatttcttctcagcttacgaaggaatgtgctttctgtacgtggcagccctgatgatttgacaatgatgaacacatttaagttgtgctccacttgtttacaaaagtctccttttgctagcacatcaaaagcattttttttctctcctgtagtacaatggtatattcatgctttcagcccttacttagagttagaagcatcacttgattggcgcttaccacaatgcattctgaaacttcatttgttattactgttttaaaaattgcatttcatggaaatctatttgtggtttgtgacatcggaattgtagtttagagaaatgaccccgtgcattaaaatgttgtgtagcatttgttctaggttgaaggtgaaagcttgatgactagatttggtttcattgatatgctgatgcctatgctgctttccactagaaagcttagatagaagctcagctgggggctgcaattgtcagctgtgttctttgggtaggacacaatcttccgggaactagctcttctttcaagtaaccatccttgcactacctgaagatgatagataatgtgggtctaactcctttcttgccatgcactaagcactagagtgtaaaggggggataaacaagtttaaaagttcactgtttgtcgttaatgaagcatcctttttgtcatttggggttttcatttccaagttcttctaattttgtaaaacaggtagcaggcaaaaatactaagcctcataatcctaagaaacatatatggcaagaaaacaaagacaatgtattttattgaagcgattcagtgcttactggaaaatgccatgctactccagagtctaaagcaggataatcggtgaagatatatact

SEQ ID NO: 139115 - DNA, 1121 bp, Homo sapiens
tgcagaagaagatgtgcttctgttccagtctggcaaagacaaacactgatggttgaggctattagcaggacgtgcatggtgggcacatgaagatagtctcctccactgcatctcatggctcaccctgcatagttatttgtaaaaggattttgagataattgagcaatttatgtgtgtgtgagagagagactccaggagggaagggggtgggggaggaatgggtgtttacagggtgggagttggtgcaccttgtttgttttgggtcatctccctcctctcccctgtcccaacatgtatcttttatctaatctatgtcttcaggaggcagtccaggcttactaattgtgatcaatcacaactcattcttaagttcatggccaagccttcagtgtcaatgtgatagaagcaatttctgtctctattttagccccgccactactgtctttttttcttttcacacattaggtaaaccccacagcccagtgtacccatgccctgttgaagatgatctactgctcccactgccggggtctcgtgactgtgaagccatgttacaactactgctcaaacatcatgagaggctgtttggccaaccaaggggatctcgattttgaatggaacaatttcataggtgagcaagtggttaacatatttgtgttgctggagatagcttagcttccagtcacaaggaatgttgtaattggcagctatgaaatttgtttgtttaagtgtttgctatttagtgtttgtcagaatcctgactacgctcaactactttgagaatagtaaaaacattactgcaagtgaatgttccctcaaactaatggtggcatttctgaaggtaatagatacagtggctgccaggttttaataatgagaaaatgcctttttcttggagacagagtctctttctgtcacctaggctggagtatagcagcacaatcatagctctgtgtaacctgaaactcctgggttcaagcgatcctctcaccctcagccccccaaaagccctgggattataggcatgagccactcactgagaaagtgtctttttgatatttcccgcctgaaagtcagttgtgtttatgattataggcttgtatccatgtaaatgctggagt

SEQ ID NO: 139116 - DNA, 1014 bp, Homo sapiens
aaaatgcatgtgcagctttacgagcccaaagcactttaactttgggcctctcctcttagctttgacttcttcagaaggcatgacatcagcaagaagcaatggatctgtctggagggaagtaaatacatagaagagcttcagatgaactgcttttatcaactctgttggttcattgctctttgggcctgggagtttggaatgttgttcatcactgcctgctctacttctatgtgtctgtctgtccaggcaaagaacagggcttagttgatctagcactgactccaaccgattgattgagagaattccctgtgcaggcaggcttcagccctttcttgttcattgtccacacccatcttcatcaccctctctcgaaagaattagcagagcaatggaaactcttgtaataaatatgactctaacagcaaggatggtacatggacacaccctttctgcagatagatttggcagtgtgtcagcagttttgaatatgttcatactcattgatttagtaattccacttctggatgtgcatcccaaggaaagaaagatctgcataaacacttatgtacgatgttaataggatgttcatcacagcattatttctagtggtaggaaattggaaataagcttgcatgccccacaatgattacactattctccgtccatgtggtgtcattgtatgcagccattaaaaatgatggttctgctgggtgcagtggctcacgcctgtcatcctagcagtttgggaggccaaaatgggtggatcacttgaggtcaggagtttgagacgagcctggccaacatggtgaaacaccatctctactaaaatacaaaaattagccagatgtggtggtgcacgcctgtaatcccagctactcgggaggctgaggcaggagactcacttgaaccagagaggtggagattgcagtgatttgagattgcaccactgcactccagcctgggtgacagagcaagactctgtctcgaaaaaaaaaatgatgcttctgaagaagt

SEQ ID NO: 139117 - DNA, 1436 bp, Homo sapiens
tttagcatagaatatgagaatctctgggaatttataaaagagactttagttgacatggaatattatattgtttattgactacaccagttttcctgttggtttagccatctctctgattggaaagttcttttgctttttggagagggctttattattttattttctcaaaaagggaatgaatatttttagacttcctggaacttgttagatacacatgttgcctgggcctttgcaggagcctcacaggttgaaatgaacctaaatcaaacctttccctcttggacttcatgaatgatgatagacattgactgtcttactttttatcttgcaggtgatcatttgaagatctgtccccagggttctacctgctgctctcaagagatggaggagaagtacagcctgcaaagtaaagatgatttcaaaagtgtggtcagcgaacagtgcaatcatttgcaagctgtctttgcttcacgttacaagaagtttgatggtatgttattcaagtcatatgtaagaaccggcagttaggtctgtactgtagctttttcacagctcctctgctccctcagtgcttaagttttctcccaagatgttgtccttgttggataccagagacgagtttaccctgtagctttatggctagaatacttccggatgcactggaatctgtatggtaggcattatggaaatatggtcacaaggagacaaaaaatagattagtttaacttaaatgctttgatttattttcttgggtgaacacagaatagtgttgttgacgcaagtccctttaaaaaaaaaaagacctcataataaaaagcaggcatctgaaaactgtcttagtcaaaataaagagaatttacagatgctggacttcaaattaaatttcaaaatggatccccaaagacaactagaattcctaaaagttttgcagaacacaggcaggattaaagttcttgagtttccatgcagcagagacccaaaagtagccattttactatagtcttcattaagctgggctccatccaacctcacattagctgaagctctggcatagtctttccatgtaaaagccacgacagaacccattctaatcacctatgccagacgtggcttcttgcaggcacactttctcttaatattgaagaaatagccaatatgagccaattgaaagtgtactttgatcctatctgaacaatggtacagataacagactttaaaaaatagaatatggagtccaaaacacctcaggattcttttccctggtgctgttcactcagtttgaagatttttatgaagtagatttagttttaagaggattgatttcctttgtgcctgttttaaaggccattctaattacatagtacctttgaagcatgcttttcttgacattatgtgtggtgaagaagtacaagacaaattttctagatatgaaatgt

SEQ ID NO: 139118 - DNA, 1254 bp, Homo sapiens
ttccctgcctccagaccctattctcctgcctcagtggcacctcagggccatcatttcgaatatcacttacttctaccctggctacacacacagatgcagtaagaggccaggcccacagtctagaaggaattgttcaccatcctattataaatcattttgataatttttcttaagtgcactggcttactgaggtttacctgccactttttctgcccacagagtctcacaagctggcctgtgttctgttctctgaagatcccatgcactgtagtgcttagtgctggctgtagtggagcccaaccttttgtagtctgagaaaaccagtggtgtgctctataagtgagacagtattcagtgtgcagaaggtacttggcagaactataaatccatagacttttggaaatatctctaagatccataggctgggaatcacagaactgaaccattgaaaacatgtgtgtgccattatgtaataacatttggagctttggtcttggaacttgatattatgatctgacatgcttttacacttgaatcatctcagtgcatacctgattcatgccttcattacatacttttgacctctgaaatccatgaagctgataaggacttgggaaggctgctctcatagcatgtaaacacttggaaggctgatgaatgttctgctgtagtgttatatcctttctgtccagctcttgagggattgcttattaacatttcattatccagtcatctgccatttctgttcttactgactaaaaaatgtgccctgtaacctaacatccagtataggacgttgctccatctttttgcaaagaaaagtatgtgaaacaactgtaactatttaggaaagatgtgtaatgcagaaaatagtgcatatttgtaggttttaacaggcttatttcctcttctaccaaaaactaaagagaaatcagtctgcaggtttagatctttgaaaataaatgcattctaacttttatatctttaatagagattcctaagatgttagtgttctgaagcatctttactatcattgtttgcatccagcatcagattaaaaatcaaataatttgagtgtgatagagctgttcgttggagggtctgcttgagggtagggaggctcaagagacccagatctgaaactcagcagcctctcaaataggtagttttgacttgggggcttggcaaaatattgtcataactgcaatggaaatggaagtgagaagaggtggatttatggcatgatccacatta

SEQ ID NO: 139119 - DNA, 1039 bp, Homo sapiens
attcatatactataaaactcacctcattaaagtgtacaattcagtggtttttagtatattcatggagttgtgcaaccattacctcagtctatttagaacatttttatcacccccccaaattaactgtgtaccattagcagtcacccctcatctccctccctctctttctgccctaggcaaccattaatctgctttctgtctatggagtgatgttttgagggcccagtctacaatcacttccctgtgataagaggagtcatgtggctactcacttgctcaccttgacagtggcctgcctgatgtttgctcattttcctccattaatttgacatgtcactaattactttagtgtcaaagttggagatagtttacctctcctttcctattctagagactccagaaagggaccttggacaaccttgaagtgaattgcctttctgatctctgactttctacaaccccgtttttggcagatcatcaactaccctttgcccctgagccctggtgatgggaaaccccaagaactggaagttcccttgaggttgggattttgtaacctcagcgctgagcctgatgcctgcctgcctgccacatagacactcagtgtcactgaatgaatgaacttaagcaatactgttaagatggaattaccatacctttttgacacatctgtcactatgaactaattgagcttatttatgctctgtgtgtgtgtgtgtgtgtgtgtcttcaataacccaactgtagaatcattttaaaaatagcaagtaaagctgatctcagaataaattctaggtgcatcccatcttgtgtacgtagcagaaatggatgcatttctccctaccttctgtttcttgtgttgtatgttcgattcctatccaggagaaaacaagatgaggctttatgttttagggaagaaaatggaaggtttagagaacatgtttttatttattgttttctaaaaatgctatagaaaacagtactccaagtagctgttttgattctctttaattcctttcttcttcatctgaggatgaac

SEQ ID NO: 139120 - DNA, 1122 bp, Homo sapiens
ttacaggcacccaccaccacgcttggctaatatttgtacctttaatagagatggggttttgccgtcttagccaggctggtctcaaactcctggcctcaaatgatcctcccaccttggcctcccaaagtgctgggattacaggtgtgagccaccacgcccggcccacatcacatgtataagactccactgcttgattaggaatgggaccttggagttaggatctggcactttcgaagtttttgtaaagaaaattcaggactcctcagtctccaggtcaacgaagtccagttttcatgttattctgttattgtttgctatttaggattgctgtagtctacagagatgtaactgtttgaggtggaaaatagaacatatggtatttttgcctagagagcgagggcagtggtttttattcttggctgaccaattgtttctctttcttaagcactttctatgtgccagcattgtgatttttatgggttatctcctttaatcctcacaaaaccctgtaaaatgacccctccctcactttccatataatggaactaagacttctctaagtcacttgcacaggatcagtcagcatggatttgaacccagatctttcatttttaaacgatttcattttttttgttgaaactcacataacataaaattcaccatttcaaccaacttaaagtatcagtggcatttagtatataaacagtgtcatccaaccattaagactatctagttctagaacattttcgtgacttcaaaagtaaaattctgtacccattaagacaccacttctcattcctgcctccccccagcccctggcaaccactaatctgctttcagtctctctggatttgctcattctagacatttcatataaatggaatcatacaatatatgacttttgtgtctagtttctttcacttagcgtaatctactggcactttattcccttcatggtggctgaagaatattgcactgtatggacacaccataatttcattatccattcatcagttgatgggtgcttaggttgcttctgccttttggctatggtgaatagtgctgctgtgaatgtttgtatacagctttgtatgtgaacacctgttttcagttttcttagat

SEQ ID NO: 139121 - DNA, 1205 bp, Homo sapiens
tttatgctcttttccccatgtcccccaacctgacaacccataaaaattgccttgaagagtatatggcttgcaaatgtcactgcaagtcaccctgtttgcaatcccaagcaatactgagtccttgaactgaatgctctacaacaaatcaaaaagaatgccttcctgtgagatagaggctgtgttgtacttaaatatacttactttattcactcacagctggaaaggtgcaggacagtgataacgaggtaatcctagactcttggggacatcagttagttacctgtattaagatgcattttaatatttttgtacaaacagatgtgagttcattatgagtcctgatttagggttctctggctgtgacctgaggcctgtggaagtttcagagggcttctgcagagatcccaaaaggcagtgctttcctgctgggttagagactatgcagagagagtgtttaaacagagtccagcttgacagctagcacagatactctttctgttgtgttgggagccagtggtaggtcagaaaagggaacactggctattaagagatttgcaggaggcgtaagggaagggtttgcctgagatctgactgtcttggtagcttctcagcactcctttttacccttgaggtctttgatgacacccttgggaaatgatgcccgacctgggacctttcatggttcctgcttgtacctgtcacgctatagcccggggcctgagccttctggagccttccagaaatgcttcacagaaatgctccacatgtaccaggacaatgctcagagtctgcttttggattgggctctcactcctactcaggtaattgtgcatccttacgtaacctttcaaaccgaagactgagacatttatagcaaccctaaagttcctctcatctcctctttcctctttcaaagtttgaactttgagattctcaggggaaacaacttttttttttttaagaaatgactttaattcactgcaggttttaacaacagggtatggccactctcctgttttcatctgaaggaaatggctttgtttgacagagatccttaaaacttattaacttttgaaaaatcaatagcactattccttccaggaaaaaagaaaaagaaaaaggctgtatggctcctttttacaaaggagttaaaattgtcagaatttgttaggccttttacatttttatcttgcgcatagccattt

SEQ ID NO: 139122 - DNA, 1098 bp, Homo sapiens
ctatgttcccatttgtcttaggctagacattagttaatacgctaattcattatgaaagatgagtaggtgggtgagaggaggaaagggaggcaagttatgtgtacatcagaagagacctcattttagaaaagatcaaaaaaagcagtttgaggtgaagaagtaggctgtggagcttttttgagacagctggagttcgaccggtagcttagatcataacgagaacgctggcttgggtgtgcctctctcacttcaagcttctctgcttgaagttgcgcactgggaagaacatgctgcctcagccagtgcctggaatgttgtgcatgaacttctgaaagactggagaccctcctccccttatgtgagtgcatagtcgctgagtgtgaatttgaacccagcagttcttccttcagaaggttaaatgtcaaggcattaacattcagataagtcgtcttactcaaaatttgctttaggatgctcctgcccgaaatctaacacccatgagtgctcattatgttcagaagagtctttcaggctatcaggtccaacagcagtatgtacccacggtccgtggtgctggccacatgtatatttcatggtcacaacagagtcatcttgggtagagaccctgggtaatttccatcccatctttctacctttcccaatttgatgtccccctcttcccactccctgtactctacatatagtgaaaccagatgagctgtttccccaaaacagccgggactgtcttctcgtctcgcccgcaggcctttatacacgtgttcttcctttagcctaaattttgccctccctaattctgctgattaacagtccttctcatctcttgtagatctttgcatctgttttctcagatgcccatctggaaattgcttttgacccatagcattttgccatgaatgaatgaatggacattagaatgatgaattgttcattcatttattctgtaagcatttatcaaatatctcctgtgtgcccagctaggtgtcagttattagggatataagagagagtaagacagacgcagttccagtcttcaaggcaatattctaccttatattaaaattggcagctgggtgtggt

SEQ ID NO: 139123 - DNA, 1250 bp, Homo sapiens
atttttcttggcagtgacttcacagaaagtcctgttttttggtgccagagtaagcagtcattacattccttacaatttatagtcaaattattatctactattgtttaaattgccttaattatagaagatttccctgtgctaagattttaaaaagcaaaataagacaactttttaccaatgtactttagaaatggtccttaaacatcacctgtcaccaggatgttggaggctatggtaaggattagttctttgtgtttatggggagattttttttaaaggggagtagtgaaatgagttcactttaaactgaatttgaattaaatgcccccagctggctggttggttaatgttctgccttgttgtttacccacagtttggaactaacttttctttctgccctctcagatctgatgggcctggacacattctgggaggctcttctggtatgaggtcaatggattattaagcagtgaggcagtcttagaagatgttcgtgtattctttaggttggagagcaaatgatgaaataacaaccttccacaataagggactgcatcaattttcttgtaatctgaataaagatttaggtgactggatgggatatgtttcagcttagctaatgtttcataatctctacctttgggctctgctttcaagatatatgtaaaatttgtcatcttaccatctcagtgactactatcctggtctcacccctcattacctcttgcctggattattgcagtcgcccatatcagttcccctgctctagctctctggctctggctctccccagcctgtgttctcagcatagcaaccagtgtgatggtattctcttaaacttagatcgtatcactcctttgctcagaatgctccaatggttccccatgccagctagagtgaaaatcaaggcttatgagcacatctgccttctcctgtgccagcccacgaggtcttctcttctcaggctttatctttatccaggtcccatcccactctagccatgttggtctctctgttttccttcaagcacaccaggcacgttcaggggcctttgcacttcttattttcagtgccttgaacaccctgctgccagatagcagcatggttcactccctcacatgtttcagggctttgattacctatcaccttaatagagaagcttttcctggtctctgtataaaataggatactcccacccccccaccccctgcagacacacacatatattcatatacttcgtccttcttcct

SEQ ID NO: 139124 - DNA, 1085 bp, Homo sapiens
aaaattagaatacaacacagtggtgataagtgccatacaagcgatacagatgacgagaagggagtgcccaggcatttcaaagagagaagggatttaggactctaatactatagaatattaactgggtaaagctagttcactagtaaaaatgaaaatactaatgaagataagtttaaaaatctaaccattttcattatgcctccctccataaagacaaaggtaaagggtatgcaacaatgggcattttattactcatctatgttgaaattgtttttaagagtgaggcagtgggttagaagcattcatgaacttgccaaaggtcctcttcacaatgacattgaatgatactcagaactttgtgccctagttgcagttttggagtttttatttcttgttcccttctgtgttcatgagcaatgcacctatgatcatgtgctcacacacacatacatatgtacatgcacaaaggattccaggactcctataagctgttatgactacgtggaaaaaaagtacgtgtgtatgtgtgttggagaggtagcaatactttctaatagtgagttgattatatatgacacacagcatgtgtctttaagatttgtattccgccttccccaccgtaagtaatgtgttggattttgcaatgaatctgtgatctcctgttttgttggaatcatcaatttggctctgtgtttcacttggggagggtcgaattgagccacagggcctatcactgtagaaattgtcccaagtagtttacaggaggtatcttctggacatgttcaaaaaagaatttagttaaagttctggcttatgcagctcagtctctggttagaacatataaatataaaatgtctgattcagcataattactgttttccttttttatttgattcacgttgggttgcatgcaatttcaggattaactggagactagactgaggaatgaaaaaggaagttttttgttatgtgtacaagggaaacaacattggcgttaatctgaggcagttggaagtgagtctctctggctccccaatgacattaactgttttagcactgaggtttttttcttatttatgttttta

SEQ ID NO: 139125 - DNA, 1829 bp, Homo sapiens
taaggtgcagggcctaagaaacgtacactgggaacccacagcaccccctccccaccagcacacatacacacaagaacacaaccacatggtatagtcacctatatggcatcttacgttttgatacccataagatctggtgaaaatgcccttcaagcaaaaccttgcctgggaggagatgttgcaaagggctagcatgcaccctacaatgtggatgcagccaaaggggagtggggtgcagcctgttcgctccccactcctgcttgctgtgatctctggaaggagcacttctggctggctccttccactgcctcccctctccccacccccacccccacatatccttctttttcccatctcacagtggcctttttctcccccataaaaaagggaatcaaagctgaggctttccagtggtccagacacatgctcgagctgtgcatagtgttatactgaggctatgggtagacttgcatttcaaatccttctcttttgattgacagaactggcctatgatctggatgtggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactgactgcctggtgcccagcacatgtgctgccctacagcaccctgtggtcttcctcgataaagggaaccactttcttatttttttctatttttttttttttgttatcctgtatacctcctccagccatgaagtagaggactaaccatgtgttatgttttcgaaaatcaaatggtatcttttggaggaagatacattttagtggtagcatatagattgtccttttgcaaagaaagaaaaaaaaccatcaagttgtgccaaattattctcctatgtttggctgctagaacatggttaccatgtctttctctctcactccctccctttctatcgttctctctttgcatggatttctttgaaaaaaaataaattgctcaaataaaaatgtattggccctttttttgcaaaccgtcgtctatggtgactgcgcaatgctttttttttccttctcactaaactttctatccaacatattcttatcaggccccaacaggttccttgaaacccacctccctgccttccttctgggtggaaatcaatcctgactccaagaaccaataagaaagagccactccctcgcaatccacaatcttcatttcgaaaccttgggttggagtatcttgtctatgaaaccgaagtatctcaaaagagttacctggtctggtctctctttacaacttttactttgccaaaaatgctttgcccaaataggaatcctctatgtaaatcaggtacagttacaccattcatcttctcccttctcccaaatcaagacaggtgagcccaaacagtgcaaagaaatcactccccagcttctttgctgctgtctcaggcttgctgttgcctctctccacaggggctgccacatggcatgggcagccgttgctttgggtcaggttgcagaaggtgtcatcagcaaacccatgatttatagggagcaactctcactcttggcctcaggtgagcttcttcaacattcatttattcaacgagtagattttgcatacctgttgggtttcaggtactgtaccagatgctggagacagtggaaaacaaaacagaactgagccctgctctcatggaactgaaggtctgacaccagtagtaattacaacactggcttttcatcatcaaccataggcccagtattattactcaaaatctg

SEQ ID NO: 139126 - DNA, 1615 bp, Homo sapiens
cttgtcttcctggctcccagatccccctgtgcatgcctatccatgcctgcttgatgcaccccaggtccagcaacttctcccccaaagctctgtgtgtactgcctccaatggaagttgttatgccagagtttaaaagcaaaacagaaacaatccagcatggatgtgtttatagccaggatctctcatccaagattaaaaaacagctcaagaaaaaaagagaattcagaatttggtagctgatgaatatcaccagagaaacatcccaagggaagcaactgattgacctgacttgcttatggaggccctgtcagggacagccaccttggctgctgtaagtggaagactgattacagcctgcagcaggctatgtccctcagtgggctgcaagagccttggaatcagagagaaataaaactagaaggaaacttagaggtcatccagttcaacactttgatttaccagatggggcaactgaggcccagaaaagaaggaaatgacttgtctaaggtgagataataagtcagtagctaaactaggcttggaacccagggctccagactgccaggatgcacaggatcacttgaggccaggaatttaagaccagcctcctagggactctgctaggagacgctgaataaccaaagatggagggctctctatttattgcttttctcaatacagaaaaacttttcaacacacaaaaaaatgcagaccttaatgactgacaattattttaaaaaagaattatctagtctacaacacaaaggacatgaaggcgaaatgagagtcaggggctgaatgtgtaattagtacagatgttgagtctaccctttgggcatagttaaactgattacaaatagaaacagatttttggatttagcatgaaaatctccttgctggcccaaaaggttctcactgatgatcaagatagaaacaatttatgtgcattttataatatgtacctaatacagcaaaaatacattctggaaaatcactgataaacataaagatatgaatgattgaaaagagaatggtttgtggtgattctcataatacatctggtttgtagcaaactgagaagtttctggtttgatgtagatttagccactttgtagggttttttttttgtttttgtttttttaactttgctactggctgattccccagatactattcccacaggcttcttgtttatttcaacacaagatgtctgacaagtctctccctcttagagctgtcttccacagtgttaacaatcatctttctaaaaaacacaaatcagattgtgttgtttgtttacttcaaaaccttcagtggctccctgttgctcacagaatagttttactttcctaatccaccatgatttggctcttacttgtccctccgccttacctttcatctcccaccacctcttcccccacagtgcgcgcacacacacacacacacacacacacacacacacacacacaccacaacaatgtccattctgtggctcctcctaccatggaggctacttgctgcttctgaatatgcctcatagacattctctgagcttggtgattttggtcaggctgtaccctctgcctggaataaccattcattcagcccctgccat

SEQ ID NO: 139127 - DNA, 1060 bp, Homo sapiens
ctgaggcaggagaatggcgtgaaccccagaggcggagcttgcagtgagccgagatcgcgccactgcactccagcctgggcgacagagcgagaatccatctcaaaaaaaaaagaaaatggctatcaggacaccccaaaaaaagtagccaacctaaatgcgcagagcacaatggctgagtgtgagtggttggctgaagtaaatgtgatgcttaactgtatgttggtatcatttatgccatttttgaaagctggccatgcctcaaaaaatacattctggaactaatttcctattttaaatggtgttcaatattgccttttgtcagagaaaccgttctcacttgtagatttataaggtaatacaaataaacatcaaagaaataaaaatattatgatcaaccaagatgtgagtttaaagacaaaaagaaaaattttgatctctttttatgcttctaaattctcatgatacttatgccatacacatatgtataagtttataaagctgtgcgataataaaatcacagactttcacagtaggtaggtttaagattgaaacacaggagaaccatttctcctgtgagatttttttttgagtgcttatatgagcactcttaaaatccaaccacagaatatcctgtctctgagtaataaaattgggtacactggctataacaatataaagatggccaagaaccaacatggaatggtgaatcactttaagcatttggtcatggggccaaagaccaggctcttggacctagactgtgtatctaattctacttcagtaaatcaagctagtgaaggcagtgggtctcatgctgagaaaagaaggaagcccagactcaaaggggtctaattctgctgggaggttaaagaatggatgcctttcatggaattattttgttcaacttagaatgagtcgtccacagatgtgcccatttcatctcatatttgtttatacctctgctttaaaacattctttttctgctgggcacagtggctcatgcctgtaatcccagcactttgggaggccgaggcaggcggatcacctgaggtcgggagtt

SEQ ID NO: 139128 - DNA, 1164 bp, Homo sapiens
gcatgacatttacaaggagacatattttggctaacagaaagatgaactatctctttgagctattcctcaattgaatggattgccctgagaaacaatcagcttcctgactttgaaggtatttgactagagaataaataagcatatcaggccaagtgcagtggctcacatgtgtagtcccaccactttgggaggccgaggcaggcagatcacttgaggccaggagtttgagaccagcctggctaacatggcaacatcccgtctctactaaaaatacaaaaattagccaggcatggtggcacacacctgtaaacccagctactcaggaggctgaggtgggagaattgcttgaacccaggaggtggaggttgtagtgagctgagatcgcaccacttcattccagcctgggcaaccaagtgagactgcatctcaaaaaaataaaaataataaaaaaagagagtaagaaatattggctggatggggcttaggtgtcagagagtggatagatacctacatcatgatggacttttgacttccagggtcctgaatagctctgaggggctaaatttttatgatgtaaacatgtaaatagaacaaaagagaatcaatatggtggagcaaaccaatgaggccatttttcaggctgggggaaagaaagaggagtggagaagagaatctctgtggttgtttgtctatgagcacatgtcaccaattatgattttctgcaactattttcctaagaaaacggatccttacgaatggcagagacttttccagggagcaattcttttcaacatcttctgtcattcacagcctccagatttgttttgccactacaagaatccagttctcatttctccccaattatctccaggcttgtggccgtcctgccccatgttagaaaagcaaacccaggacagagccctccccccggctacaagcagttagtgctgattgctgtattgtcaatattaaggttgtccagttcacactcatcccctgcaccactctctcccttctgattctgcccacacagaatagaccagtgcatctcaagttatctatgatgaaggacccagagtttgtttgtttgtttgtttcattcctcccaaatctgtcatggaccaatatctttgtagacaataaaactaaattaccagaaaaaga

SEQ ID NO: 139129 - DNA, 1039 bp, Homo sapiens
ttggattataacttattattttagctgtctgtagcatatattccctttttatagttactttataatctgaacacaaaataacgacgatctcaagtaaaacagcaattaggaaatattttcataagccaatgatctttatttttatttatttatttatttatttttactggatcaagtgtaatcttacacttctactcctaataagcctgcacacataggaaaggtgaaggacacctcaatggcttaagtgttcttctaaagtgtcaagtcaaaccttcataaacgtaggctggtagtcattttgcattaataaattcattaatagagtggtctggtgaaaagggtcattggaaatttatgataggccttttatcatgagtgacaactgcaaaatattaatgatttagaacaaatcatgttgcctgctgaaaagtgagtagaaagcttgtagggaaatgaaatgtcctgggtttttttgtttgtttgtttgttttttgtttttttaaatgggaaagttgttaggtcctatgcagaactcggaatacattagatacagtaatatatctatttatactaccctgttggtaacaagtccaggaataaattatggcagttttaccaaaatgtattttatagtgtgagtatcccaattccccttcctttgtgctctttggaaatgcaccattcagatctttgtcacgtaagttgtagattgcttcctgctaagtaagccacccctggaactctcaggcaagatcttgtagtgactgcctccaaactcatttcttgggatatcagcccctccaacatgtgacctcagtgcaagcgaccccacgtcatccactgggagggagatcccatctgttgggcaaatgagacaccttcttacccttagactgttgaagtttgagatctaaagggaagggcgtcacttctacagagtcaaacaaactgggtcccagttctgtgtctgccacttcccaatgttgtgaccttggacaaagtcagtcagttcctctgagccacagtttcctcactt

SEQ ID NO: 139130 - DNA, 1043 bp, Homo sapiens
tatttttagtagagacagggttttgccatgttggccaggctggtctcgaactcctgacctcgtgtgatccccgcctgcctcggcctcccaaagtgctgggattacaggcatgagcccccagtgcccggcctgcccattttatttctatagagattgacctttttttctttcatcttaaattttacccatccttcaaggtgcaattcaagtgtgatgcagtgaaaagaaaataggtcttggggtaggacaaatgtttatttaaattcttgctctacttatgagcaagcatgatctgggacaagtttcttagcctcccctctatgtctccattctgtcatccattaaatggggatcataaccccaactttataggactattaaatcgagggggaacatttataaaacatctaggcaagtatctagcatatgctaggtgttccataattgttactttctctccatgaaatctttcatagccatctcagtccatagttacctctgtcctctgaattcattactaaaatgaattctgccagtgctttcatgaaacagtctacaatggctcccaggttccataggacataaagtgaccactcagagcctggcaacctattagaagaatgttgaataaacatgaaaagtaaaaataagagaagctaatgttcattggacacttattatgctctaaacactgtgccagagcttggcatgcattgtctcatatcattttcacaataccactatgaggtaggggtcattactattctcactttacagatgagaaaatttatactggaggtgttctcactcatagtgggaattgaacaacgagaacacttggacacagggcggggaatatcacacacaggggcctgtcctggggtggggggaggggggaggggggagggatagcattaggagatatacctaatgtaaatgaccagttaacgggtgcagcacaccaacatggcacatgtatacatatgtaacaaacctgcacgttgtgcacatgtaccctagaacttaaagtataataaaaaaga

SEQ ID NO: 139131 - DNA, 1145 bp, Homo sapiens
atttggtaggaagcattttgtggttttaatttagtgactgtaaatttgattattgggggcttccatagggatcttttctggtcttggtgtcctcttagctttgccttatcatgtcttaagttcctcatcagtgaattgtatcatggagactttcaggagcttaaataccatggtatgagaagatctaatgcaatatacactctggctactgcatgatgtaagtagagtcaaggagtagaccatcacatcaaatgctatggaaaggttcagaagtctgaaactctaaagagtataagcagtttacacctacgtaaatttgaaagtgattttttacagcttctgtgtaattcattgaacatttttaatgcctcctgttaataacacactgtgcagacccacctgagaaatatgaagagctgatgcattcctggttgttttctttcagctcctgagaaccatgtctatgcccaaaggtagagttctggataaaaacctggatgaggaagggtttgaaagtggagactgcggtgatgatgaagatgagtgcattggaggctctggtgatggaatgataaaagtgaagaatcagctccgcttccttgcaggtaactgattagtgctgacccaaatgtaatctaaaaatggtgatgctcaggaattaaaaataaattgaacccgctgtctgcaattcccttacattccctgcaacacacaatctcatcaactcttcaaggaaagactatacaagctctagaaagtgaagttctcaggtagcctccttcttttcctcccaccatttccaacctttggtagattaaaagggtaacttcctgtttttcattatctaaaatgaactgacctaatcagttggctctgtttctcattggagttttccttggttcttctcatttataaaaagaaatgcataataagaaatgcaaatttgggatgaaataacctgtaccataaacccccatgacacaagtttacctatataacaaacctagacatgtacccctgaacttaaaacaaaagttaaaaacaaacaaacaaaaaaaagaaatgcaaccttggaagtcttctgaaaaccactggtgagataactttcaaaggaagagccattagctgaccttcttttcttagga

SEQ ID NO: 139132 - DNA, 1070 bp, Homo sapiens
taccaaaagcagggctcaaattcctttcctattcgaaaataccagcagttctgttcaatttcacattccttcatctactgtttggccatgccagtcaaaccacttgaggtacagaaaagagaactacactacaacaaggaagtacttaatcatttggtagctgcagaatataacttggcttgccaatggcccgcataagagtctagtggtcttctgtgaccaacatgttacaaaagctatacatgctgaattcagagagacccaatcattttagcatctttaatgctgtatttgccaaacaaagcactgttttaggatatgtcccagttttttatatttaaaagaatgacctgagcatttcttaagttaatgtttacttaaggagtgaagctaaaaattatacaagggcaccattcctttgctgctgttgcttcagcctgtaaaggtgtatgattagataggaatattgcaatgattttattcttgtttcctgagagacagcccatttcccccttaggattcagtgacctaaaatttgggaagagaaaggcttgaaaatctctgacctccaaggaaactagaagctcaaaatagagtttttcaagtcccagtctcaattatctgaaacatatttaaaaattcatattcttcaaatagtataccagaacaggaaaactgctctcaccgaaaacctatttataaaccctgatctagacctagtctttaaaggaaggaagttttgtcagaaactagaggcatctcattaatcctcagtggactagaggccttctggaagaatagtgaaccgatgtcccccagtcattgaggttgactcttcaagcccaatgcttgatgacatggctgctgtggttcatacacagatgttatttttagaggcaagaattctcatttcccaaaagtataaccacaagatgtctatttggaatgaatcacatttatgcatttggacaatagtaaatgttcagatcatgtctgtgcaacctcagttccctgaagaaatatgtaatatcctggtacactctcaccccaggacccttgccctctgtcag

SEQ ID NO: 139133 - DNA, 1057 bp, Homo sapiens
cagactagcataatctctccatcttgcaaagacatttttggttactttattgaggtataatttacatctcataaaatttacctattgtaaatgtacaatgcaaaatgttttcctgaatttatacaattgtgcaaccatcaccccaacccaatttggaacatttccatcaccccaacaagttgccccataggcctgttttccgtcacttctcattcccaccccagccccaggcaaccactaatctactttctgtccttatagatttgccttttctgaatatttcatgtaaatggaattctacaagatgtaatcttttgtgtcaggcttctttcatttagcatattgtttttcaggttaatctgtgctgtagcatgtgtctgtactttgttcttttttgttgctgagtagcattccattgtacaggtatacattttgttaagaatattcattcaccagttgatggacatttggattgttttctgatttggaatgtatgaataatgccgctgtgaacatacacatacaaatctttgtgtagatgtaatatttgcacttctttgaggtagatacctaagagtgtaatggcttggtcatataataaatatatgtttaactttttcagaaactgctaaactatttttgcaaaatggctgtaccattttacattcccattaacaatgcatgagggttctttttatccatatcctattctacatatggtattgtcattcgttgattatagactttctggtgggtgtgtagtggtatctcattgtggttttaatttgcatttccctagcaagtgatgatattaagtatcttttcataagcctattatccactggtacatattctttcatgaaatatctattcaaatagtttttaatggatattttatagtttcaatggagagaaaaaagtggaaagaatatgactatgccaggagattttttgcattctcccctcctaagtattcatcagtctttgtttatttttgtagttggctttgggagttttgtttgtactgttttgagcaagtaaagggctgacatggtcc

SEQ ID NO: 139134 - DNA, 1197 bp, Homo sapiens
gactgttctatagtgttgctatgtgctattaaatagcaatcgcatttcaccgagtggagaatgcatgtggaaatcctttgggagaagtgtgctgtagaaatgttggattgacaatgttttttttcttttgtgaaccaggaagtgtaagtgtaagaaacagatctaaacactgttcggaataattgttagtgtgtacggcagagtaagcaatgaccatatatgcaagcccaggtattccagggctcaacagggcccattagagatagggaaatgaaaacagaatgttttttaaaagtaatttaagtgagtgggcttatagttcagaataacatataaagaattttggagttttctggaaagtagacagcctctatttgaatgggcctttgcaatttatgaagtgttttttttttttttatgtacacacactgaattcccataaccatgtgagataggtataactcttatcctgatttcacagcataggaaactaaggatttgtgaggttcagggatctgcataaggtctcacttctggcaagtagaagaaacaaaatagatgggaatccaggttttctgaccttaaatcctttgtctgttcagcacaccataactagatgagtgtgttggttgtggtttgatgaatggagtgtgagtctggcatactttcttaggtatattttaaacactgaatgactagaattcctggagattctggaaagctcagttgttttttgacacctgaaggttaggaccaaaatttcaaaatgttaaactgttttttaaaatacagtttaacatttctaaaatagacttccctactttgtcacatgattgctttctactgtagatggaggtgctttaagttgtcactcttttaaactgctactggccttggctgtgtcccagagacctccaggcctcacagcataactcaaataagtgctctccttctggtccattttcactttcttgtcattttcgtgttgttggataaaagtattttgcataggtaaaagagttagtataccttagaaatgactaatttctacagagcaaggagtttactcattggataggatcctctcatagagatttattattattaaatattggctgtgggatgaaaaagagagatttcagaagagcaggaatttcattttaaaaagtgtcaacttgaacttcatggagttaatgt

SEQ ID NO: 139135 - DNA, 1050 bp, Homo sapiens
atgcaagcaaaataatttaaacaaatttcccaaaatttgacatttaaaaatgtttggagctgttctgacacagacattctgtgttctgtatttggtttatggactatgccaggctccttgattaacaggtagaggacatacccacagttcaatagatcaacacatagtatttgagttcttactctaaatgtttattgtttattcagtcactgagtgtcaggtacttgggtaggctctgggagagacacaaagatgaatcagacacagtaccaccctcaaaaagcctttggcctcatagaagagacagatacagacacaaataattacaatacaaggcagaatgtgattgagattttaagacaagtccaaacaaaatgttttgtgagcacagatgaaatgattagattcacctgcaggaattggggaagaatttatggaagaaattacatatgagatggttcctggaagataatcagaatttcaacagaggggggatcactcaaggctaagagaacagcgtggacaaagcacagaggtgtgaaactgtgtggcatatttagagaatgttgattagcgagatgtgtgcggtgaattctgggagatgaggttgggataatgaagtggaagtatacagtgggcagttataaatttgaattaggagcctgagggaaaagtctagacaacagaatttttacttaaaacaagcttgtccaacccacggcccacgggactcatgtgtcccaggacagctttgaatgcggcccaacataaatttgtaaactttcttaaaacattatgagatttctttgcgatttttttctttttttttttttttagctcatcagctattgttagtgttagtgtattttatgtgtggcccaagacaattcttcttccagtgtggcccagggaagccaaaagattgtacacccctgatttaaaagtctaaaaagtatcattccctgtgaaccacatgccttgaggaacaatattagaactcagcatctgttctttggggatccacaactaaatttgaggcaaggcattcat

SEQ ID NO: 139136 - DNA, 1050 bp, Homo sapiens
cttggaaagttcagctgagaacaggagcatctggggcttattcatggtttttcagaagtttttgaagcttttttattagctgggttgacctcagattgaggaggagatttttcaaatgttaaacagttttttcttttgcattcctaaagtcatattgtgttcagcttgttaatatctgcacagggggccttcggcagaggctgccagagcggcgtgcttttgggacatagttccctatagctggtatttccctttcttgttgaggatttgcatgtgtctctttcatccacgcatacagcagattcctccacaaataattgcatttgacatcacagttgttagagaaaatgcaggggagggggaaaagcctccctttcctccacactgagacagctggagggaggaagcaggttagacagggaaatacataaacatacctggaatgtagcagcaggtaattctgtctgtgttagtcatgataataacttgcatgttggaatatcaatagtgtagattccaagatgtctaggatttagaaaggaacaaagaaaccaccacatatcaacacctagcatctcactgatttactgtgcctaagacaggaaatattggcaaacatgtttagttagaatcaatggagtatgttccaaggtgccttccccaaatattttttacagaagaactttaggcaatttatttccagcttctagtggcaggggcaagtgcaccctgctgggaaactgaaatctggctcatgatagactggcaggagttgggggccggtgtcagattccatttgcactcccagtagaagttactggaaccctcagaaaggcacactctccaaaaaggagtgtttgttcagggcatgacagtattgagaacagcaaaaaataatctatccactaacactgtgaccagcagtaactttctatgttagaaattaaccagtactgcctaaacagaagccctcattcttaatggtctgcaaaatgttccgtggctaaaacttttggaggtaagtcagtgatttgatttttttttttccta

SEQ ID NO: 139137 - DNA, 1023 bp, Homo sapiens
ggaaaatgaagacgattttttatatgtgtgtgtgtgtgtgtgtgtgtgtgtgtgtgggtgggtgtgtgggtgtgtttaaatcaagttcttcagattttcccaagtttgaactctgccctgaagtagaggctctataaataggcaggctgcccttggagtacagcttagagattttaccacatgatccagaagtcccattttaatcttcagccccaccaggacctttcatggaaggatggtatcaagtggagagacttcagagctataaagatcagggcaagttaatctgcattccttttgcattttgctctctggttgaagatggtgagaggttcctatatttaaaacccggttgacatgatatccttattggccgatgtctcacaggaggtatttagaatgattttgagcagcatataatatgtttgtgagtgtgtgtgtatttcacatgccaacagagcagaaagaattcacagggcttgtggctactgagctttcttgagacaccatcactctcagctgttggggtgatgtcacagttacaagtgacactgcctaggcccaaattcccaaagctcttttttgcattgcagagcctagggcagacctacaccatgggctctaccttcaaagaactatggaatttgttagccacagactgggaccagtgaccacttgttgtcaggcaaaaggaaagctgccccctgctgcctgagcctttgtgcctgcctgggataccatggaaaatggggaaggaatccagactcattaatgagctaatacaaaagattaagccaagctagaggcagtttgttatagctgcatatggatgctcgaaggcagtcagagctgaaagatctccagaccagaacccagtggtgctgccgcctttgtttgccagacacaaatataggataagggtatccccatggggagcaattttcgtattgccaatttcttttttcagttatgtcattccccgagctgttgtgtgacaaattgattgatcagtaattgcaatct

SEQ ID NO: 139138 - DNA, 1028 bp, Homo sapiens
ctaatcaggccatttccccttatatgtgcgtacatgcacatgccttattgatcagaggaatggcatagacatgctgggtctagatttcagcaaggtgtttgacagagattcctatgatttgttttaaaataagtaaggagaaacattggctaactgatcatctacttggataaatgtgtagctaattaattatcatatatgaaatgtatcaatatcagcccagagtgaggcctttggttattaactttgtgcttagccccttattgcctaaagtttttgctagtgacttaactgaagatagagaaggcatacttctaatatttagtgactgcatgatgctaggtgggggttagtgaatacatagataacacaattgggatgcaaaaatatctcagtaggctgcaatgacaggagaaaactagcagagtaatatccccatggggataaatgtgaagtattacatgtagattcacaaacatgagtgcctaagcatgataggggaaatccaacttagcacacatgttagtttttagttatgatggaaacagctatgaaaccttcactgacccaaaacaatatcccccaaatattgtgataatttggcaactctcttgatgttgttgccatttttggtgggaagagagggatacgtatttacatgtatgttgaggtgggagagggagagacatggaagtgactagaaaagtactctccaccgcttgcagtgagccgagatcgcgccactgcactccagcctgggcgacagagcgagactctgtctcaaaaaaaaaagaaaaaaagaaaaaagaaaaatactctccaccctgtttaaaggttaaaaaggactgttttgggattgtgatgttcactgctccacatgagtttttgttacaccaatactacctgttttagttgtaaagcatcactggtatgtgactgagagtctcagtgagacatctgagagccaaaacactggattatttagtttgggggaaagaacaaaggctttagagccaaatagatctatt

SEQ ID NO: 139139 - DNA, 1062 bp, Homo sapiens
ttctgttagtgagccctacttcatagaatgatgttaaatggtcaaagataattaaaaaatctagaacagatgctgaaatgtctccacttccatccccctctgtaaacaccagaaaattatttttaagatgcctggcagactctagtgcaatgaagaaactaacttttgaaatagaaagttaaaattttttaataagttaattagtaaagctgttaagtgccaaaggagcactcaggacattccttagcatgtgattttaataaaatgtttgaaatgaatctcagacatgatggaaaacactccaagtaacttgttttcatagtcttctcacaataacaccagtgagagttgtaaaacactggcctagtgcagtggttgctagaaaagccaatattgagctaaaatttctaaataaaaggagaaaccttttgaaagtcaactttaaataaaagaccttcccaaatggaattatgtcccagtgtctgtcttacttgttcacaagtgacatggcagaactctagtaattgccatttatttccatacggagccagaatgtgtgtgtgtgtgtgtgtgtgggtgtgtgtgtgtgtgtgtgtgtgtgtgtgggtgtgtgaaggacagagtacctacaagacatgttagcaaaagccaatgaatgacttctgagtcacaaaaggacaatgtgagttagtccttaaataccagacttagactctgtggagttaaacattatttcatgaagtaaaagggaattctctgatatattccaaaacggatttatcattaaaaaatcttctgtcactttgcctaatagcctgaaaaataatcacaatgtctggtggctttggggagcatgtgtttttaatatcttaattactatatacagtttaataacactgcaccaagaagaattcccaagtatttcatactaaatttcttgaaaatgaactatttgctatatttagaatacacaggattaaaggtacttaaattaggtcatgtattttagtccttgcatattaaattaaattactcaaaaatggaagatgagtcagaaatggt

SEQ ID NO: 139140 - DNA, 1513 bp, Homo sapiens
ggaagattgcagagaggggcaagtgttaagatctgccataagcaatgagtagggtttgagtaggtaaagacaagcaagggaggggcagtcataagaaagatcgagtgaagacctgtgggcggaccccaccctagaaaatgggaaagctgcatcagacatgggcttctatatgatcaggcagtcactaaaaaatatttatagcaagtcctttcagcaaaggctttgggcacagtagaaagaatttgggctttgtatccaaatggatctgaattcagttatagattttgctaggcgcataactttgggtaaatcagttaacctctctgagctttagttctctcatctgtattatggtaaagatatcaaaaactccagtgtatatctatcatatacatatatataatatgtacacatagatatatgtaattgcatgtgcatgacaggcacttaatatatggcagttagttgtgaggactgtgtttaggattttctctataggcaggacttgagtttgaaagggagttccagtactttctgcgagtctaattcttctcccccagttttgtatgtttgtagatccctttgatgcatctcttctttctctcccatattgtctccttcttttcctctcctctaactttcagccacaaaagctgaaaccagctgacaggtagggagatgtacatagagtgagaaaagtcgctattacaattcctttttcctacctctggccatgaatatgtgcatgaacattttcagtttctatacaaataccattgagcagccaattaattctcattgataaaccagttttacctgtttcagttgagctgttaaaattggttggactccaaacacccacattgattttttttctcatctgtgttgctttatatagccaaaacacattttttcagtccttaaataaaatttatattttggccatgattcgatctgaaagtgagacacttcagggaagtcataaagaagaaagtcatgatgatgatgatgatgtcgatgatgatgataatgataatgtgttctctttgtatagcatttacccatatttcaaagtgatgtcatgttctaaagtctaactgcttaggaaaaaaatccaacttggaattatataaggtataaaactgtgacagaatcttttcaagaactcattattactcttaaaccttatctcattttcactgtttttcagaaggtaagggataaataatgtttgtcctttttatagttagagaaactgaggcagaaagccattaatggctgtatagacatactgccaaaagatccagtgagttcagtttaaaactcaatcaatcatccagatgtttcctatacactgccaaacatctggattcactgaatgcctgactaaatcggcctaaagatttggtgatagggaggaagaatcaagttaactttctaagttcacatgtaattgagtggtgaatctgagaatgtgatgttattttcctaagccccttgctcggtgctgcat

SEQ ID NO: 139141 - DNA, 1124 bp, Homo sapiens
gatacccagctccagagcctacaggaaatggtgggaggaggaagaagaggagaaggaagaggtaaagaacatggaagaatctttctccttcaaatgagtagaaggctcacacacagtgaaggttcattctgtgtgcttcactgtcatgaccttgaacctcccctagcacagctctaatcactctgcctggtcattggcccttactcttctagactccccactggactgagagcacaataagggcacacagaccttgtctgtcttgttcattgttgtattcccaacatctaggggaaaaaaagcatgttgtatatatttgttgattgttgaacgaatttttttttactgtaaatagacactatgtggagtggtctacttttgcaccatgaggtcgtctcatgagcttgtggtcagtctgactgttgatgccaaatacagtcagcttttcctttgtttgggactttctttgacaaaccttttctttaccttcacctttacagatacagccaaaaggcagcaaggaatggaatgaaaaaccagttcaatctccatgagctgaaaatgaagggccctgagccagtggtcagtcaaattattgacaaactgaagcacattaaccaggtatgtggaatataaaaaataataataataaaaagtagaaataaccgagagagaggaggagggggagagagagagggggagagagaggggggggggagagagagagagagagagagagagagagagagagagagagagagagagagagagagagagagagaaagagagatatagccagcttccactgttcaaactatattcttgggcttttaggaaagacgctattatttcttcaaatagtctgtctgctagaaaggacttctggccttatttttcaccccacttttaaattataaagacaatattgcaatttgaggggtagcttggaaaatagagggaaaaatatttctcacaatcccactattttatcccaactgttttcatttttacatgttctcttctaatatttgtccagaaaggcacactcacacagactttttccataattagaaatccacaagtgatttgtagttctgaaaattaacactatcttggaaacactt

SEQ ID NO: 139142 - DNA, 1093 bp, Homo sapiens
ggtgcagcaaaccaatatggcacatgtatacatatgtaacaaacctgcacacttaaagtataataaaaaaagaaaagaaaaagaaagagaaacagatttacatgccctgggtttctttcctagattttgcttcctctctactgaaatctacttgtaatttctgaaaggctgttgttggagaacacaggtacttcttggagtaaagtggatatatctgtttctagcaccctcgtagcttaacattggctctgaagtagtactgctatgcaaacaattatgaaagacatttttttcacatgaaagtttttagtttataaatcctctcatgaaaaatccacaatggccgcagataacatattgcagccctttacttcttcgactttttgccagcaccaacattggcctttgcggtccccctgactttctttattgggttcttgcattcctttcgttgctttcttgaggtctttttcttctcatacaggccatgtcttgcaagtctatgtttgggttcatttttctttgcataatccagggaatcataaatcatgccaaagccagttgtcttgccaccaccaaaatgagttctgaatccaaatacaaagatgacatctggtgtggtcttgtacattttggctagtttttcctgtcttaggcactctaaatttctgtcttaggcactgttgccttcctggggtcaaggacatcaatgaccatttgtttcccctgaagtagtcggttggtcatgaactttgtagtttggatagttaccgtgtcgttcatgatggctgtctatcctcagacagccagggaggagaaagacatttttatttagatatgtgcataaataaagaagaagctaattgtttctgtctttattaagcacatttacaaatctcagctcttttcacctttgctttattttactgtgcatttatgtaaattaacactgtatcatggataaagaaaaggacgttttcttaggcctcttaataggatggtttttctaccctgttttctggtttgtctttaaagctatttatgctctttaaattatccagtttttcccacagtgattgttgtggccagaatg

SEQ ID NO: 139143 - DNA, 1040 bp, Homo sapiens
atttgtaaatgtgcttaataaagacagaaacaattagcttcttctttatttatgcacatatctaaataaaaatgtctttctcctccctggctgtctgaggatagacagccatcatgaacgacacggtaactatccaaactacaaagttcatgaccaaccgactacttcaggggaaacaaatggtcattgatgtccttgaccccaggaaggcaacagtgcctaagacagaaatttagagtgcctaagacaggaaaaactagccaaaatgtacaagaccacaccagatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaatgcaagaacccaataaagaaagtcagggggaccgcaaaggccaatgttggtgctggcaaaaagtcgaagaagtaaagggctgcaatatgttatctgcggccattgtggatttttcatgagaggatttataaactaaaaactttcatgtgaaaaaaatgtctttcataattgtttgcatagcagtactacttcagagccaatgttaagctacgagggtgctagaaacagatatatccactttactccaagaagtacctgtgttctccaacaacagcctttcagaaattacaagtagatttcagtagagaggaagcaaaatctaggaaagaaacccagggcatgtaaatctgtttctctttctttttcttttctttttttattatactttaagtgtgcaggtttgttacatatgtatacatgtgccatattggtttgctgcacccattaacttgtcatttacattaggtatttctcctaatgctatccttcccccattcccccatcccacgccaggccccggtgtgtgatgttccctgccctgtgtccaagtgttctcattgttcaattcccacctatgagtgagaac

SEQ ID NO: 139144 - DNA, 2704 bp, Homo sapiens
aaacaaacaaaaaacctttgccctaggctgagactccagcctgagtcctagctctactgtgaacttgttgcatgaccttggacaagtcactgcacttctgttttttcttttacttataaaataaaggaatttgacaaaatcacctctaaagcactttccacctataacaggctatgagatcctataacaaagatatttgatgggggagggaatatgaaaggaaagggaacaccataaagctaccttaatgactttgaatttgatgccttcccaagtagaccaaagtgaaagtgattcgaaaggaaccccagggtataatcattctcctgacgacagcagtgagctcttcattttactcctccaggtattattggagctacaggggagcaggtaggttggctgtttgagatgtcagagttgttctcgatttctaatgttggagagtttggggtacaactcacataattaaaccttaaagaaaatgtttcccccatagcactgcataactccaatggggcttctgagcaggaaaaagaaaatggaattcaatgtctgttgctcccaataatatttgacacaactgtccagaatgaaaattagaagccctctaaccacagagatatataagtgacaggagagagacattgggggagtgccaagggctgaagggcaggttaagagcaaaggaatacaaagtggctaagaaaaccagagggagagagacaatttccaccctttccaagaccctccaggctagagggcttgggtaaattttgacctagttgtccttgtgtgcatggctgtgagcttttattaagtatttatgcagcagtttatattttaccaagtgctttacaatcacttttatttggcttagtaaagttttcctggaatcccatctactttatgatcagaagagtcatttcttgtttgcttagcacctccatgtgtacagcctcacacaataggccacttgttccagcaggagagcaggtgcaaagagttgagcagtggagggcacctgcagctaccagggcagttggagtgggtgtagtttacacttcagctcaccttttctccccctttgttattctttcatgttatgttattgctggcaacttgagagtggcagggtaaggcttgggcctgtcgagtgcagagctgtcctgcatatggacactggcaaaggtaggctctttcccctgtgccagtgtctctgcccatgcccaccatggccatgcacttccaccaggcaaagacttgctgagtgtgtttctttctgctgcttcagggttcttgctgcagccttggtcctagatctctggacatgagtttaggaagactatagaaagagcagttctactctctgcagacaagaccagccagtgttcttggacaaatctaacacttagctaccttattcttggtagtcccttctcccttccagcaaccacggcagcccccctgcaccagcactctggattttgtgatgtaggatggtgtggctgtatagatggctcatgaagcaatatggctacacactctcaatcaccggtttgcagtgggaatccaacacagtcatcagttggatgtttccttttctgaagaccagatttgccaaggcagaaactaaatgctggttcgtgaagtccagaccggaattagtaggccagaacattggaaaattcaggacctccaacaactaaagttctgtggctgagaacagggctatgtagatgcttaataggtaagtgtagaatagatgatgacactcagtggagcatagaaaaggaactctgctgttctctaggttgccactggtttctaaaatggtgtgatctggcaggtgggacacattgacaggtttacctcgaagggcccagtgtaacataggtcctcagtcagtggctgcagatttgggggaaaggccccaggggcaacaggttgacaagggttaggcagagtagcttagagtctccatcacacaaactgagcattggatggggccttttatctcaggtcagttcagtagacatttattgagtgggtactgggtgccaggtactgggtaagggagtgggcctagaaatgaatacagacaagagccccaggacagagttttgctcaggaaaacacagctggcaagaggaagtcatacctgaacacccggggctcactcaaaaaaacatgaaatactggcttggaggaacaaaacgaattccagagcctggggcctgacaagtgagtcagttaaactaacaccttcctgcccttgtcactactggctcaggatctgggtagggctaattctgcaggttgaaggtttgaggcctggaagtgactgtgactaaggccagaggagctgacggaaaacagtggcaggaatgtttagctttcttttcaagtgtatcagtagcacctatttgcatgaaaacagtttgttctttgaggctgatctttggcaatttattaaccacagttcagccagacatccaaaagaacactgaggagcctttcctccctctgtttactacatattctagagatgccacacaagagaaaaatccaccaggcacactttttcctgtttcagacttgcctctctcccaaacgtgtctggagtcagttaagagtgattgtttaggtggactttgagagtcctgttcttcattttgaagatcaccacattaaagaatggatgttt

SEQ ID NO: 139145 - DNA, 1061 bp, Homo sapiens
ttcaaaaaaacctataaaaaagcccttgaagatctttactgggagatagatggagttaggcctgatattggctcccttcaataacccattcttaacttttcaggaacacctacccccctctcatttttatgttatttcctcttttttctgcaaaaacatcaaaatcccaatccttggtcatggttggttcaaatggtgggcatttgagtccactggggatcaagtgagagttatttgcatctaagggtgtgcgctaggctggccttcttaccttcagcatcttgtttcacagcaaagacatcttaaaccatttctcctatgactgctttatagagattaactcgggcaatcttcctaaattacattaaaaaccatgatgagtctagttgcaggtcaaaaatagttgttcagtgctctaaagtcctttctgtcacccttgagttagcctttgtagaaaaggagaaagatcattaaaatcagtcatgatttcccaatttctcaagccaatgaattttattcttttacgtgagtatggctttgatccatgggtttgtctcatttagaatgtagtttcatttccctggaaaagaaatttgttttaatttgtaactccagtgtcacaggagcttcctattttttgcccgctgagatcttagtgatccacatggtcagatggatcttaaaaactacccaaatgaactttttcttggtttgagccacttgttggcccattttgtcattgttctctttgcttctaatcacagcttcgggcctagagctgggatgagtacttgttcagcaggagccagagtaaggtgttcccacctggggtagggatacagcagttggggttggagggatgcatagaggattgcactatgtaagaactcatgctgaaaagctaatttccaaatactattagggagcactaagacaaggaccatcttagaatgggctagaaaaagagccattggctagcttacccctacttatccttaacattatctcttctgaggaccctggatcctcctgtccacacctttgtctgggttaaggcttgc

SEQ ID NO: 139146 - DNA, 1108 bp, Homo sapiens
cagtggtacgcagcagttgctatacatcgcttccatgctctcgtgctaaaataagttattatttgttgttgttgttgttgttttttaatttatagggtggcttttctccaaagtgcccaaggcagtatgcatacaattttaaatatagaatagccaatgcaaacatcaatggggaaataaataaataaaatacagagccaagaggaagagggtacagaaaaacataaacaatggacaatggaaataatattcagtagcattgagtcaggtccgaaagtccattgattcaggcataagtcagactaaagtcatgctgaaggtgagactcagtagctcttctcagccactgttgtggtgatttgagggttagaaactgaggtatagtcttcaacttcccagctctctcttctcatagctagttcttcctttgcccctatattggaggaggctctgcttatgaaaggctggtgggagggacagagggacaaatagggctttggtatttgatttatcactatctatctccacagttcctggtccccctaagacatttttggatttcatttctactttagttttcccaggagcagaaacatgacacttcattttttccgatttggggaactgctatgttagcctgagtgtgtgcccaagaatgaacatactgaagtataatgatgctttgctagtatggcagtttacatattctaccttgccttagataagtcaagattgctcttggaaagcctttgaaggagaaatggattatgcagaaagtgacttaatttggtatagcatgaaatatttatggcagctaagaatttttttaaatcctggtaaggcagaacagatcagtttggagagtacccccatgtaataatctctctatggacttagattggcatatttttcagcagcgatttatcttagatgtagtctttaatgacagatatttatcaggacatactctcgtggcaatacagtaacatttatcccttaagattatggtgtcatatacagtagctttaccttcagaattgagtgagaaaaacacagcttatgctgctgacggatggcttaatacagtgtgctccattcaggatgtgtt

SEQ ID NO: 139147 - DNA, 1050 bp, Homo sapiens
gtgagtcacttaacctaaaaagtcttaaggtcctcctcctctgtaagggaagggcatctcacaggattgttgtaactgttaggagaggtcataaatgaaaagcccctagcaaactggcacatgctggaagctcaatttatattacttctctatttttccccctttccccttcactcctcctctttccaacacaaaacaaaagacatgtcagaaaatagcttgttcctcatctatgctattttactgacatgggacaatgagaataaggttgcgtgccaccctgaatgaggcactgaaattgtatggagatacacttctctctggcaaatgtaaatcagcctggaaggattaatggctccatgcactggagaaataatgtatatttgtcatcctaaaagctcatcaggtactaagaagaatcatgaacatttttttttaattttcagaaaaaaacagttggtatttggctttataaaaagctgatgctttaaaactgatacaaacaataactatttgaaaaagaatatatccacaggtcaaatatgtgcttcttacataaacttgatgacaaaccattccagtgccttgtccagtgttatgttactttagcgaaaaatgaacaactcctgaatatttgttttaagcagcttatcttctaaccatggtttcttattaaaaaggaaattttactttacaaatatatttatttactgatgtgttcattcattcacgtattcattctaacaaatatttgagcacttatccaatatcaagcactaatatttgtttcttcattgtgattgtttgaagcaaatattataaccctgctggatttatcttctattgtttatggtgaaaaatcagatcgatccagttttagttaattgtaaaataatttattcctaggcctatgtattttgaattagtggaatttttattgaattttgctcatactgactacttcatgtttggtacactttggtgaagaatgatgccctggaaccaagaaatttctcttctatcaaatggtggattccgaagcctgctaaa

SEQ ID NO: 139148 - DNA, 1673 bp, Homo sapiens
atcaatgcacccaattacactcagaaaccaaaagatatgtagtgctccagtgtaccttgtaatcagcacctttgaaaatgtaggtaacagcattctgaataagaaaaatggaagtggaacgtcttagaaaatgaatgttggaattaaatcatccttctgatagaaacagcaccttatatggcagtcaactttttttctaatatcattttattgatttttaaaaaaaaactaaactgtggccttgtagccaagaatgtctttaaaagtcatttattgctctaatcagcctggcagagcctttctgtcatgctgataaggaaattaaacttttctcatactgagtttacttgcctcttatgcacagatgttttgtttttcttttagggaactaattcagaagttgaagtctttcatcagcttctatagtgctttgcctggctacatctgcagccatagccctgtggcggaaaacgacaccctttgctggaatggacaagaactcgtggagaggtgatcttttttgaaagttacatatagcaatatttgaggaataattgtcatatgtttatataaaagttaattatgtcttctatctccattaattgcaccagaaaaattctagagaaatctatgaggctggatgcggtggctcatgcctgtaatcccagcagtttgggaggctgaggtgggcagatcacctgaggtcaggagttcgagaccagcctaacacagtgaaaccccaactctactaaaaatacaaaagttagccaggcatgatggcgcaagcctgtagtcccagctactggggaggctgaggcagaaggatcatttgaacctgggaggtggaggttgcaatgagctgagatcgcatcactgcactccagcctgggtgacagagcaagactctccaagaaaaagagaaaacatctatgacattccagatgatgtctataatttatagccctcctagaagttgcaaagtttgaaacacatagagaactgtgtctgaaggcaattttacagagtttaaagcataaaacaactttcttttgtcttcgattcttccatctcctcattatgtgggtccttatttatttgatttgaagaaatcacattcatcttgaaagctatcatttattgagagttaattgtatattaagtaccatgctaagtgctttgtatgtattatttatctttataaaaatcctatgaaatgaatactgttattttcccccattatacagatgaagatagagaaaggaagaaaagggagggaaagaggaataccatttcactgagcaattttactgaaatattttatggagcatttgtgggttttgtttgtttgcttgttttgtttttttgtttgtttttttttttgagacagagtctcactttgtcgcccaggctggagtacaatggtgcgatcttggctcactgcaacctccgcctcccaggatcaagtgattctcccacctcagcctcccgagtagctgtgattacaggcacctgccatcatgcctggctaacttttgtatttttagtatagatggggtttcaccatgttggccaggctggtctcaaactcctgatcttgggtgatccacctgcctcggcctcccaaagtgctgaaattacaggtgtgagccactccacccagccgagtatttgtt

SEQ ID NO: 139149 - DNA, 1038 bp, Homo sapiens
ttgggaggctggtcttctattaactgactacacaacccccatcttctgcaccagttcttcctaaattttgcaattcccttttgtgaacttcttcatacatattaatactaagtgccattgaaaggtatcaatagcgtgaggcctgcgttgacagtcctctcaaatgtatacttcactgtagaaaaaaagccattttttatcttaggaaatctctgaataggctgtacttagaatggggcccccattccccgtctccagccttctttccaccagtggttctttgtcttacaagcttatcaccttttttgactctagtcatagctttgttctgctatttaaaattgggggaagaaattgaagtgcctttcagaatttgtttctactatcatatctgcacaagtatcatataattatattgcatttcttttttcagattggcaagttatgtgcccattctcaacaacgccaatatagatctgcttattatcctgaagatctctttattgacaagaaagtattaaaagttgctcatgtagaacatgaagaaaccttatccagccgaagaaggtgagaggtttcttttttctttattccacaatacaattaacaattgtattttaaggtcaaaaaccactagagtgaaacttcttaaatacatgttatttagttcttctgagtagagtgcttgattaattaaattttatcatctgtcaatgtttaaaaaaagatggtattatatccaaggcatatttaaatgtaaatttactgttcataaatatctagtacagcaacatgtgtggaaaggacttccctattcaagatcttttattgattaagcaaaattgtttctgcttacaatctggtctcgcgattccttggcttgctttgtagcttttcccattattaacagtgagtcagagttaaattcaccagagagaagctggtgagacacattcatgtgtatacacagacactgcacactttacacaccttttaaaaatgataaaatgaaggatctggttcctggttcttaaaaca

SEQ ID NO: 139150 - DNA, 1747 bp, Homo sapiens
cacctcctatctggcttcactttcaacatgggagatcacatttcaacatgagatttggaggggacaaacatccaaaccatatcaggcgaggagcacagataatacaaaacagaaacattctaccatttgtgtttgtgtttaaaatacatttagtttggggaagcctctgaactctgtttgctgaaagtgaaattcaactgaggaagaattccagaagcaggccatgtgcaagtccctgcccttttctgggcctcagttccctacctgtagaagggagaattgccctaactagtcacacagtctctgccagctccgatgtccatgtgtctgtgagtctagacatatggaaggcaacaggggaaagccagttttagatgatgcacaaagttttattgggcagctgaagttgtgcaaatactaggggggaaatcacaagctgccaaaatagtgtcacctcattgatagaatggacaaagagagaagtcaattctaagtggaagaaaccatgactgacattttaggaactgatcaaaagaagcgatcggaggaaagtgaaaataacatctgtagacaggaaggcccgggacgatagcaatgtgtaatgctgctgtcacagagggaaatgtgcaagatgagtctctttgtgctgtttttgttcaggggtcagactcttctcaattcacctgatttttttttcctctcctttcaatcatatccttttcaaaattcatctcagaagtgtttctcagccattctgattacaacttttgctaaaaccaatcagcagaggtctgcttacagtgcaaggcaatcaacagagacccaaggtattggtcagagatgatatcttcatttagatggactgtggctaatcggattggctgaagttacaatcagagcaattttgcaacagcactgctgcctaccaggtacaaagcttcctgtacaattttaggaatgatgcccggttaaatatagtgttttatactatttgcatgacaaatgaattatgaaaacgacatatgttgcactttaatattttcctttatagcctgtaatactcctttagcctttaataattgaatgacagtgagaaaataagatcaaaatttggcctcttctaacataccgtgctatgtggtggtatcctgtactctgaaccttgtaaattggaaaggcagtgacattgttttatgtgatttggggttctgtgatagggtggtatgtaatgttccatgatagtcaatcctggttttatatgccattcccatgcattcccagaaaaaaacatcttaaatcagactcaagtcttaattgtatatgataaataggaacagacaggtgaatagtaacaaactttgaaaaatgaaatacaggtacatattagtcaatatcagataagttacagactataaaggggctcatcagactgtatccgtatgcataataatattatgattttattgttgaggtgtaagtgttccttttgtatttagagtactagatccttattagatatatgatttgagaacgttatctctcattctgtaggttgtcttttcattttcttaatagtttcctttgaagccccaaagtgctttaatttttatgaagtccatttcatctattttttgctttggttatttgtgctttcattgtcatatctaagaggacattgtcaaatccaggattacaaaaatgtacaaaatttttatttaagagttttacagatttagcacttaatttt

SEQ ID NO: 139151 - DNA, 1003 bp, Homo sapiens
gcttcctggcccatgttgctgagtctgtaacctaggagcaaatacaaggaacatacaggtgtcagtcatgatgtcaatatgcagagaggagcaaatcagaaagtaggaaatccaggtgcggagggagtttcctgataggaagagcacatgggtgctccagcttttacagtggccagtgtggccactcggtttgttttttgtttgtttgtttttgttttgttttgttttgttttttggagaaatgagagccaacagaaagatttgtgaacctggaagcaggtgggaagaaggggagaaggaatatttgagcacatgggatcaagagtaggaaggtgaggtaataagagagtgactgcctgctgagagggactccataagaagaggttgagagagttggcagatgagtgattacggaagtgaataattaggggacagcaaaaagactccagggaattcctaacaggctggtttgctccttagacatttgtacaagcagtatttttagagtgatcgagacaactgaatgctaacttcatgtagtcattgctacttcctgtgtctttattatcattatttgctttttcagtgtttatgatgactcattaatctggattccctgtcttacagttgatatttgagacaatgtcctaagggagccctacccagcagccttttgcagaggagttgtaacctgaatgctaggtttttttgttacccagctgccaatgtttggatcaaaacaatccatttctgattcatgtatgttattagctctggcaggatggcaggacgtgaggcagatactgttttgtatattacagaaacctagataagcaaacagagaatgaagagattgcctttattagaaaagcaatcttttgcgatatttcttagcaccaagcaatgagtttttaataaaacctaggagatagagcgtttatgtatctagtctcactccccttctttgaatctagatatatgtgatttcatgatgctagcaaga

SEQ ID NO: 139152 - DNA, 1061 bp, Homo sapiens
agaggtgccatgggaggtatcctctgaaattacaagcttcccttaatggtctgttcttcaaaacatcctagagaaatactgttcttggattaggacctttgtttctgttatcaaaattttctcctcatctctgatcctgtaaagtatcctcacttatccttgtctctccttcctcttacctaaagtttgtggtttttaaaaaatcatttcttctttactttccatttagaagtagagaacgacatctggaatggccctcaaatatctagttttgtttcttcattttgaagactagaaaactgaggcatatgatttaaggcaaaggaattgccaaagatcaaccagttaatgtcaaaccagaactaaaacatggcttctggcaataacaccagtattctttctgccataccttcctttttttttatatatgacattgtatgcttctaaggcttatttttagacttattgtatcttctgctacctaaaaatattcaaattagcatctaagatgcttcttgattttctctgctttttgattgtaggattcctagaaatcacaatagatgcaacattagtatgtatttcaatgcacagactattatgagcatttttatgtgaaaaagagaaataaaataggcagaagatgacatttcttgccaagatattttcggatctgtgtttttacaggttacctgagaaattgtttatgatgaaggaatcaaatataaatacgcagttgagactaggagaacctctgaaatacggctcactatagaaatagtgaataaaaactttcagtcttgtttctctcagctttgactgttgcataagtctaagcaaatcaatataaaagtgtttctcaaaatgtgcttcagttatagccaattaaaggtcaacatatataatttacatgaaatggatgggcaggaacaaaaggtatctgttgggccatgaggaatgattctatttcatttgcagatgagtactataaaggtcattgaaaatgtgagatgcaaatcattgtttttttaataaagcattttttctaggtttggtctctc

SEQ ID NO: 139153 - DNA, 1926 bp, Homo sapiens
tacatggaaggagttccctattaactaagtttctgatttactcaactgcttattcctcttaacaaattattaatgcaaaatgaatgagtttcttgactgtagcaacctgctagcatatttttttaaaaaattgtgaaccctttaaataatctttgagcagtttcttcacaagttctagacaaaaaagcagggaactaaactaatgtccttactctggttaaaaataaagcaataattgtgacaaattggtataatcagacttgacagatagaagctatagaattcatgttagatttctatcagtctgaaaaggatgttaacaattcccagatcacagagagtgaaagaatacacagtggtggaaacgttttcctcacacatctgtgtttatcaagttttaaagtctgtttcctcccctaccatttctcctgaatctgtaatacattgatttaaaaacaattaatgcatgactcaaactgctctgctctgaaaggccccattcagaattgtctcggttctggttagcattgaccgaaaactctatgagataccaggaataataaattacaacaaacattcatttttaatggcaccatagagatttttaagagcaaacctttctagatggaaagctgagtcaataccctgcacaggaatggatcggcttggcattgcaaggagcagaggaagaaaaggttgtgtgatgcagtgaaaagaacatgggcttcaggagttaaaatgtgactttctctctctctgttttttaatttattgagacaaagtctcactgtgctgcccaggctggagtgcagtggcgccgtctcggctcactgcaacctcttccacctgggctcaagtgatcctcccacctcaccccttgccccatgccataagtgggactacaggtgtgcaccaccatgcctggctaatttttgttttgttttgttttgtttttgtttttgttttttttttagtagagacagggtcttgctatgttgcccaggctggtctcaaactcctgggctcaagtgatcctcccacctcagcctcccaaagtgctgggattacaggcatgagccactacatctggccagactgtgaatttctattcagctgttctttttcttagtgacctgaacatgtagtataatctctgagccttggttgcttcaactatagaatggggataaaaataccaacctcgcagaactactatgaaaattttgcaacaatgcctaccacgtggcagcactataaaatctgacatgtaacatgatctatttaatctgctgtgaggcaaaatagccttttcttcctaggccttctctcacatggaggcactcatctttggggtactctcattagtagcaccatcattgataaatatttacccgacttctgtgacaaaggccctatgtcaggagctgccaacacaaatacactaatatccccatgtccacagagagatatgttccaagacacccagtggatgcctgactcccagtggatgcctgaaaccacagatagttccaaaccctatatatactgtgggttttttttccctatacatacctacctgtgataaagcttattataaattaggcacactaagacagtaatgacaataactaatgatgataaatagaacaactccaccctttcctactgaagttcctgctagtctttgcattcagaaattgctgtgtctctgaacaagtttattcagcatgtatggctgtagtcctctgcttctatttgcccagcctttgccactaataaccaggagaatcaatcatatcccccagatgttcggataaattgattcacagccaagcagaccaagttgaacacacaggttttgtaactactcacagtggtcttcacagaagactcatgaataaagggcagtgtgatatatctggattc

SEQ ID NO: 139154 - DNA, 2343 bp, Homo sapiens
gtttatccctctcctggaaactttcccaaaactttctgtaattttgtttacttcctttaatccccaaaataactactcacatgtcttcacatggtggtttgcacttttatttttctacttgtacacacatacatactttattgattcatctcagcatttctcagagttagtgcttcctctcccacaatttcattaccttggcttgttctatgcttccttgaatattgtgtagaattgcaaccttttctaccaccattacttctccctttcttttttcgttgtgatattcattttagcactatctgaaatacgattcgttgcaggaagcatttattgagcatctaataatggaagcactatgatagccactggggatcagagggagtagctggaaagatgcacatgactctgttgtgttgccctcagcggtcacttggctagtaggtggcagaactagtatttaaagctgaacctgtctgactcaaaagctcatgctcttaaccattactctatattgctctctcaagcagttccattctcttcagcagaatcttttttccccaaacacagactaagtaggtttttattatattatttaatatcctgtattactccctactgtttttccagctgcacaatcagtttctgaattcattctccctccttggagacttttgctctagtatttcccaatgaagtactaaaaggcatgagatttacatcttcctaacacttaaaggaacagtgtagtttcatggaaaagaaggaatgtttgtgcaggtgatggaaggtccagtcacacagtcagatgacttggcctagaatctatgtgagcagtgccggtggtgagaaagaggttctcttccacttgcaaagttggaaatctgccgattggaccaacacatagtttttaatgcatctgcctttgattccggacagtagaagaacatcagatctccagtacggagtgtccttggtatttaataatagtaacattgcctactgagaacctaacgtatccaaatacatccatttcctttgctaggatttctgaggtcagtatttatttttgtgtgccaggaagctctggggaagattctctgttgatcctcaataataattaactccatcaaactcttatattttgctgtcagtgtgagtgactgtaactcgtcagaatttccaagattagccttaccttcctctccactgttgaaggctgaggttatttctcaggtgtcagaatgtcagtgtttttctcctcatgctatcactttggactttcatttttcagtctcagatagagataccttgtctgaattcatacaagctgttttcagtaccaagtgatttgaaagtgataaaaagaagtaaatggctcactacctaattagtgtctgcaggtcagcctctagaacaatggtaagcaactttacttacacaaggtttatttctggaaagacaaaaactgtttacaggttgccatcattttttcattcacaatcaaaatagcttcagtgatttccatggagaaaatacgtagttttaaaacacacattacctatttattgcaagaatacaaatgaaaaaattggcaccatgttttaggcaataaatgttaactttatggtaggtttcaaaaagtggttacataaggggagctttttaaaaatgtttcatcctgaaattatacgtatattacaggtcatattaagaaattagatgggttcttcataaatctagaattgcttgcccttgccttggcataatcgccagttgcttatatgttctgaatttttagagagaaattttacatcctttctgtggtcagtggactgatgtggcaggaacacatcctcaagagctgtgaaagatctgagatttttaccctgattgcaagcaaacaagctagcctactgcagtttcatcgatgttagttaatggcataagactcctgagtcagagatgaaggacagtttattgcttacagcaatagcagcagccagagtattagcatttgtgccagatccctgagtcccaattcccacagggtaaggcaaagagagctgaatgactcctgtacacatagtgagttgtattataggagagaaactttgaacttagggaactcaaatattttataatagatggtaagcccacctgctgtttactctaaagggaaacatcatctctatcttccaaggctgttggctatacaaagatacttgaaaaggatagtctgaaacaaagggtagtcagttcgtctgttcctaagacatgccaaagcacaagagatccatggagaattgtcttccaacacatggtcccccacccttggatggc

SEQ ID NO: 139155 - DNA, 1450 bp, Homo sapiens
tatttatttatttatttatttatttatttatttatttatttttgagacagagtctcgctctgtcgcccaggctggagtgcagtggtgtaatctcggctcactgcaacctccacctcctacttctaatcaattctcctgcctcagcctcccgagaagctgggattgcaggcgcatgccaccatgcctggctaattctgtatttttagtagagatgggatttcaccacattggccaggctagtctcaaactcctgacctcaggtgatccacccacctaggccgcccaaagtgctgagactacaggcatgagccaccacgcctggccatgtggtgcttttaaacacatgaaaaaaggaggtgaggaacttgtaaagaattaagcgcactgttttgatcaggcactagacatgaaggttcatttaggaaacatttattaaacatctgctttgtgtatggcactttgctaggtgctggatattcaaaactacccaagaaatagttcttaagtcttgaaaaggtcacagtttagttggtagacagacgtgtaactgaatacatttcaccatagtgaacacttcaccataatgtgaatgttgaaagggctgtgagagattagctagtccaatcccattgatttacaaaggaagaaataaagttcagggaggcttacccaaagttatataattaatggaggaaccagaagtagaatccaaggtcttctgctgctacaatgtaatactttctccataataccagtctgtccccgcttagacccccctagacttttactctaagagctccattaggattttgcaaacacgtagtgaacctaaattggatagcaatttctggctgccaatcctgctacattttaggtgcatgcacatgcgtgcagggggagtgcatttcatgtcattatcattcaggaagaaaggctttggctgtcaagaggtgctcagtgatgcaggccctttctgttttggcctttaagggcctgattgctcccagctcccagctggttatgagagtgtgaattctgccatccccggggaatgcctgaactaaaccagaaaacatatgtaaactctgccttgttcatgttttatgatcaccaactctaagtaatacgtaccaaatggtgggggtaggggaatcactggccagatgtgatccaacccatactcagtacgggtcaaaaagggactgggcatttatgagggcgagggggagtcggagctgcagaactctattcacattaacaaacccacagaatgccccaaagcaaaagctggtttaaaactaaagctttaatgagattctccagtagcaccctaaccttcctgttgcgataaaatgtaaaaccctgccattcagtcctgcttgaggttcagttgtggtgagagacttctttaaaaatatcctcttcctgagctctgctgggatatcctttc

SEQ ID NO: 139156 - DNA, 1752 bp, Homo sapiens
gtcaaatatttatctctgtctaaaaatgaaatgtcctgaaatacaatttctttttaactgaataaatcagtgtgagaaagagaaataacttctcatttagccaatttttaatcaatattttcatgaaaggccgaaatgttaactgaatcttggcttttgtcatttgaaatataatttgtgtgtttaagaatttatgtgcacatcagaatctggacttcatgttcagaaaggaaaattgatttataggagcaaacaactgcaagagtagaggcaatgccagaaatgaatgagagtcaattatttaacgcaaatgggaccttaatcaccacagcaatagagaagtctcaaattcattttcacactggattttcatgctttaatttgtacacatttttgtgtctcttttttttttttttttacagaggcctttgaaattgttgttcgccatgccaagaactacaccaatgccatgttcaagaacaactacccaagcctgactccacaagcttttgagtttgtgggtgaatttttcacagatgtgtctctctacatcttgggttctgacatcaatgtagatgacatggtcaatgaattgtttgacagcctgtttccagtcatctatacccagctaatgaacccaggcctgcctgattcagccttggacatcaatgagtgcctccgaggagcaagacgtgacctgaaagtatttgggaatttccccaagcttattatgacccaggtttccaagtcactgcaagtcactaggatcttccttcaggctctgaatcttggaattgaagtgatcaacacaactgatcacctgaagttcagtaaggactgtggccgaatgctcaccagaatgtggtactgctcttactgccagggactgatgatggttaaaccctgtggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgaccaccactgtgagtaccagtctacagttgtcagaggatttgggccttattggggtgaggtggccagtagcaggtactgatggagagaaatgagaacaaaattggaaggtggggaaggggtgatgatggactgaatgacctcacagagttaggcagcatattaagaccacaggctatgcaatcgtaaagcctggctccacctacttccttactgtgcgatgttgggaagtcattttatctttatgagttcatttttctgattcatgaaatagaaataaaaagaatatcgtcttcatagggaatgacatttgttaaagcacttagcacgtgtctggtatgtggtaagtcttcgataaatgttggctattattagcattattgtcagttatcataatcctcattattgatacacaatagatgacaagcctgtgaagtgggagctattatcttcattttataaatgaggaaactgaagcttaagtgaaattgcaacttgcctaagagcacccacgtaaagttagtggaagagccatgcttcagaaattgaccaggtctccctttaatttggttatcaccaatttttctgattctaatttcctcttggtgttttcaatcatgtatatcacattagcattttgagtagt

SEQ ID NO: 139157 - DNA, 1050 bp, Homo sapiens
ttttcgcctagtgttggtttctataagtctcccaggagcctttagttgaccagttatggcttggtttgttgtcctgtgatacagaagtaagtgggttgggcaaagcccagagatgtgctaagtggattctgagctgcggaagttggagcagggagcacatatgagcttgaggttcaaagtaaacccctagcccttttcccctgcaacatgcattgtgattattctttctgcagaagagttcatgatcttttataattttctttttctattgatttaggagtgctagtaacagaaacttttaaaaatgttatgacagtacagtcaatggaatcttgctgttgtacatcttgcacattggagaatgaatgcactgtacttgagataaagcttgccttgtatagaattcattttagggatgcttggatgattgagatctacaggagtggcatatccacagcagtcttttcccttctcttcattctgcacaaaggcaaaggtgaaaggtgtgactctgctttgttggtctttgggttgcaatttcttctagtatgtttccatttgaagatgggaagccaatgggaaaataatgagtttaaaatagaactgtactttctgcaaaggtttttgagactatatgtattggctgtaggtcgaaggcagcaagcgtgtaactgttatggaagacactagtttgtgctgattgcttctactttcctgtgtgaccacgggaaaatgctttaactctactgagcctcaattttgtcgcatataaaatgggagttgtaataccaaacttaaaagattgttgtaaaaagtagatgccataatatacttgagaatattttgtaaactctaaaccatatagcttgtgaatacttctgaaacaaggatggtttatcatttatctccatctacccagcatttatgtgcctctagcacctagtacagagtctgatatataacaagtgattgctagctgaaattaaaatgaatgaatagtttcaaatctccaaatttctgatgattttaacgaatttgttgactggtcct

SEQ ID NO: 139158 - DNA, 1049 bp, Homo sapiens
gaatgtcaaccaagagctttgaccactgctagggaagacagtgttgaactgctaatgagtccctgacaaggtgtttgccatttataaacataaacatttctatagttgctactcatacttgtgagaaaacattgttgaaatggtattttttctttaagtggtaggcatagctcctctccctccttctccttatttatttacctacctatttgtttttatcctactttgtccccagaggaatttaaagtgctctacaaatatgtgcataataaatgtaagatgcaatgcaactgaaatacataggaactatcaggcaaaggggaatgtaagatggagccaggtgtaagattatgacacaaagtacataatgaagtttattatgcttgatagaagcagaccataaatttggccctaagcgttctagtaataaatgtgaagagggaaaaatgatgagttacccaaattatggtgtccagaaggttaaaataaactagttgttcaggaaagctaatggtgggtaaacgagaagagctagttgggctaatgagttggtcaattgttgcagactcatacattttctagtagttagagctattcacttctcatttctgaggaccctttgactgaattattttaattgttctctctgatctataatagcctttagggaaatatctgtatctatctatctctccatctatctatcaaatgatatatataatagcctgtgaaaagcatatatttcttctttctttcactcattcttctgttcctcattgatgtacattgtatttagaagcctagtgtgtgaaatttaaaaagcaagactgtatatatttacaggctggtcatggatctgcacaaataaattgcttatatttaatagcaacttatttctaagctttgtccattctagttaaattaatgtgaaacataaaatgccagaaaaatctgacagaaattggagcaacacttttagtgtcttctctattatttagtttttaaaatgtgaggcttttcttagcttgcagtttctatgtggctgattt

SEQ ID NO: 139159 - DNA, 1070 bp, Homo sapiens
agggagagcctggcctttttgcaaaggctagctttccaattaaatagcagagttttatggttagagttgagagctctgagatttcatacctgtatcagtaatccctaggaaatgcacaatattgacctttttcacttattttcttataatttccatttcatcatgactctaaggcaacacaggtaatgcatttctggggaattattgttgttggtaagtagttggaatcattcatatttttgcatagttcatcacatcttacccaagttgtagagttattttcctgaaatatttagtagacccagtgtagccaaacagctgaggtattaagtttacttagagtcaaaccaaaaggaaaagaaaaaagaaaaatagacaaactacctatatctggaagcattgtgacatagtaatttagtaggtaagctctggattcaaactgcttatattcaaatcttggctgttctacttactgtctgtataagttttctaagttacttctctgtgcctcagttttcttatctgtaaaatgaaaacaatactatactcacctcacagggtggttctgataattacataaattaattcacataaaacgcttgaaacactgcctggcagatggtaaatgctccaaggatgctagttcttattatacctaaagctaatcttgaagtgctctgcaatatttgcccttgaagaagatggacataatggaaaaaatattggacaaataggagttctgtgtttcattgctgccaccatctactacatagctatatgatttggagccagtcttagtttcggttacctcgtctgtgaaattgggataataatgtttcccttagcgactgttcaaacacatgcatgcacgagtacacatacacacatgctcacattcaatgatagagaaagagaaaattaagttagaacacagatttttaaaatctgaaattacatgaggcattttgcagatatggtgatctgttgccatgtatactatgtatacttaagctataaaagagtcccagaacaaaatagattaatacttttataactatatggtattttat

SEQ ID NO: 139160 - DNA, 1074 bp, Homo sapiens
cttcgactttgcactaggcttttaggctcttcagatagttgctgaagtccctaacaactgctgtagaccagaactaaggtggtagctaagcctcagaatttagctggtttggtgcaaataggtaccaagtaatattttatttaggcctacatagattagatgacctgccttctagatcacactggtattatagtatattttccagtttattgaggtgtagttgacatacaaaaagctgtacatatttaatgtgtgcaatttgatgaatttggagataagtatatacccttgaagccttcatcataatcagtgccataaacatatccatcttctccaagagtttcctcccatcctcttaatttattattttctttgtgataagaacacttgacataagatctatgctcttggcgaaattttaaatatatacagtatcgttgactatagacactattctgtatggtaaatctctaggacttcatcttgtgtaactgaaactttgtaccaattgaatgatgatacctctctgttttgccctcacccaggctctgaaaaccaccattcctctctctgctttgatgagtttgactatttaagattcttcagataagtagtatcatgtagtatttgtccttctgtgtctagcttatttcatttagcataatgttctccaggtttatccatgtttttgcaatcagcaggatgttcttcttttaaaaggctgagtaatattccattgtgtgtacatgtgagtgtgcatgtgcatgtgtgtgtgcatatgtgcgtgtaacattttcttttctttctttcttctttcttttgtttttttttgagacagtgtcttgctctgtcacccaggctggagtgcagtggctcaatctcggctcactgcagcctctgcctcccgggttccagtgattctcctgcctcaacctcctgggtagctgggattacaggtgcatgccaccacacctggctagttttttgtatttttagtagagacagggtttcaccatgttggtcaggctggtctcgaactcctgacctcaggtgatccacccaccttggcctcca

SEQ ID NO: 139161 - DNA, 1422 bp, Homo sapiens
tggtatgcaggccgcctgggctctgccttcatgactaactcatgcactcttttaataaaaataaaaattttcatggtgaaaccccatctctactaaaaatgcaataattagctgggcgtggtggcaggcgcctgtaatcccagtgggaggctgaggcaggagaatctcaaactcaggaggtggaggttgcagtgagccgagattgcaccattgcactccagcctgggcaagaagagcgaaactccatctcaaaataataataataataaaaataaaaattttctaccccctttttgttatgtgaaatttcagtaacagtgaatatgccacttgaaactgccttcctctttccttctccaaggacaaggtctagtctcccatatcaggcattagagaggaatgcttcagagctcattttgaattccagctctgcaccacttacttgttgtgtggctttgaggaagttgtttctgctccctgagcctcagttttctcacctatgaagtggaaataatcataataattaaataataatgtaattaattaataaaatgtgaggggcacttgaaatagtgcctggtccaaacgaatgtgctatgctgatattagttcttgttactattgtcatcattgttcttgttactgttatttagtcatcattataaaactggtcttctgacatcacgttaaccatgatactcaacccagattgtcaatatcagcactgtctccagtaatgccatggcattcttaggacaaaataaacttttgttttaatttaatgaataaggagcatataacatttttagggggtggggtatgacgataccatcaacccaaatgtgctgatgaaagagacgtgattccagggaggttgggacctatcatggtgaatgtattcacctggttgtttgtcgggagcagacctttctccgtgttggtgtgtgctggcatgatgcaccacaccagcacctttgtttatgatcaatagtgacataggtctgctcaaataaattaacattcttgtctggcccaactcattttgagaaaactgatttgcaagccagtgtgtaagctgacccatataaccccttagcttaaaaaaaaatgtactgtataccattgtagttttactctaacaagcattgagcgatggcaggcaaacttttctttagtttagtttttttctttttatggctacatcgactgacttctacctggcgttctttgagaggcatgtggaaaggagactgaaaactaaatacaggagaaggaaagggacacagggaaaagagggatattggaatttgtcagcgtctctgaatactggtgtcttgttctatagtaaaacctcagatctgagcaattctgaagagcttaaacacagcataggaatggagcaagctaattatgggtctatta

SEQ ID NO: 139162 - DNA, 1239 bp, Homo sapiens
ccactccagttgaaagtgagtaaaaatatgggcatcacagtttagcgatctcgaatactagcagcaggcctcactgtggatctatgcgtagacgagacagaccaagtagtgctggaaaaggggtctgcgaagggctgagacatggggattgttttgtcattcttgggaaggccaggagggggcgccagtcatttgattgataccctataatctgtgtaacgagattctttgagaatgtgttttgatcagaaatagcaatgaatttggttaacaatatctcctcagttttctgctatatatattattagaaagatatatttagaatagataaactataaaaataactccataattacaaccctagaagtttaatatgtcacagactggaaaaggcttctttgatttgatagaaagggtgtgtttgaccattgttcactgtgctcacgtgttgatatttgctatgcacaccacagtttttcctttctgggaggctttttattttccattaactttgcagtcttaccttttccactgataactttttaaaatagttttgggtatgcacctttctttaaacccatgccccttttaattttttattttgaaataaatatagacttaatgttgtaattattagatatcatgaattatgcttatgattctcagagatggccagaggtgtcttcttcatgggttacatttttgttcccaaggtatctctttttcaaagtgatgctctcaattctgccaaagcccctcgtgtagtgaattgtttatgtccaatcctgtaatttccttgtcaatatacacatccttttgctgtgttggggaaagaccatgtaattactgaccccggcacgataccaatttttacaatcttatactgaaatagatttttgtgacaattagagcagttagacagcctagacagagtgcatgatcttgggccctaatgttagtaagatggccaggctatctgcctgtctgttcatatcaatctcaacatatctttgaatgtatcgctgagacatggaagcaacttacaggggcctccccaagaccctgaaaataaggaaaatgaaatcactacctaaaagttaagctagaaaatcaacaagctatggatgagaacagaactatgcaaattcactttgaagagactgaattacaaaagaacagtggagtcgcatatttgttgtctaattttgtgaagtataaatgtagtaaaaaaaaaaaaac

SEQ ID NO: 139163 - DNA, 1083 bp, Homo sapiens
aggcaatcatgtgcgtcaacatcaagtgtcctgtcacctactttgtttaacttggctaataggaacatgaaagcaaggtcatttgcccgaggatacctgagatatacaggcccatctttctaggccctgtaaaacacactttccatctcatcttaaagaacctcaaaaagctttgcaaactacacagtggtctagaattgcttgacacctcctgaaatgcaacctatgttgtgactggtagcggctgttaaataactcctagaaattctgcccggaagttcagatcagggatggggaggtagtactttgggttgctgtggttccagcacctccagaccttggatccctagctctctgtttggcctgatctgcttgggctctcctgaccaagctgagtcctaggacacctgaaccttggacatcttttttggcctgatatctgttgtgatcacacatccctctctgtccaccccctgcctactgaccccttgacatctacccaactctgctggcctaatgagctctcagaattggcccctgctaacctgtcttcttgctgcctgagtcaaaagctttggcagtctgtttgcatagatgtaatacctattcttgtggcagatctctatctgtaaccatgggaactaggcacagacatttatatgataagcatccagtctctctatggtcatctcttgtttgtcaatgctagtggagaggagtagagacataggtaatctgatagaatgggtgatccaaaattcatttgtatttgaagttgaaatggacatacacacttcatcaggcagccatatataaagagactgctctgagtctggttctgacttctgttttatagtaaggtgctaggaacagagaaggaaagggacatgggaaaaatgaaaagaacaagaggaagggaaaaaggacagaaaggggatggaaatatagaataggaaatgtgaagagacacactgagaggtgagtgcttctttgagttaaaacaggtggagtgctgagtgcttccagaggtaactgacttgctctgttggccttgtcttttccttgtgttccgtaaatgctaac

SEQ ID NO: 139164 - DNA, 1976 bp, Homo sapiens
tatctaatcctagcaaagcgtaagcagactctctgcctttgtagtttttcatggctatgaccactttatgtgaattaccacaaggggaagacatggtccctgacaggcagataaaggatagtctttccaaaggacattgttcctgaaaaatagaatggctttttaaatgttccttgtttctttcgattatatcagttgtttctggttagaatagccatatgtgtcttagcaatttagttttcaaaaacattacatgatccacacatcagatacttttcagttggcatatcttaggctgagaccaccatttttgttgattgttgatacatagcggttcagtgaaacaaatgcttctaaagagccccttctgtgtcaggctctaaggtaaatacagagacacaaagatgagaaagacacagtcctgaccctctagcggttcatagtccagtgggcaagacaaatggacagatattttcaacatattttgatagactcagatagaaacatacaaaatgtgccattggagccaatacaaaaacatggtctgtgactaatagaatctatttttccccttgctactcactaaatagattttttaaaaattctcccttcaactagcataggaagccactgacatcttcagccacttagtagccaacctgttaccataaggaagtgcatttacagtggggattctgttgagatcatgtgaggcggttgtgaaggcacgtttacaaccccaattgatggtagttacttttggtctttctcttcctccccatggggaagaaacagacaatgagtagagaccagaggaggaaaaagaagcaccgcaaaaaaggaatagagaacctaaaaggcacaaatagtgcccccccacccaaagccaaatgtgtgcctttgaggctaaaaaggtgactgaccctggtgttaacgttgtatattttcaataagctatattcagctgtctactccttgaatttcttcttagcaacttaaacacaaacgaggcctcctttgtgctcagggacattctcaagcacttacgttctttccttggaattcacaggccctgctctgttctgtgttttattgctctcagcttatttccttttctcttgattaaaaactaaagcctctgtagacatgataagttaaaaatggaacagacaccaagcattgcttactggtgtccacaccctggaccaggtgaactgaatccagggcaattgggataaaaacactatatgggatcagccttttgcacgtcttgttcaaaggaaaaagaagtgctttaaaggtcttgctttttcaaattctctgtggaattattttgataagtttggagctgtttattttttctttcattctgttgtctcttgtgcagatggaagagaagcctcctatattagcttagtttaagtgatgctaaaagggatacatttgccggcactatcagggggcccaactgaaaatgatcacctctgacagcacaagatggaccagctctttcttttcacctcctgagggtttaaacactctcaacttttttattaacaggaacttgcagggacaagcctgctaagcttatctcattccaaatgaacactttaattcatcaaaagcttacagtgaggctatgcaggtttatagaagaaataccatacaaaaggctctcagaggtccaaggcagtgatctggttctgaagctagagattgttggttttacacacaaatatataggctattagaattgtgagcagccgtgcagttgtggcctgaggggttgtgtgcaagattggagttcataaaaggatgtcacccagggtgcagagttaggatatttctgggtttggtgacttaggaaaaaatatgaggaaaatctgtttcgctttaagggttggagtacacttactaagagcatcagagcatttatttcacaagggggtattgtcaaacttaaatgcatacatcac

SEQ ID NO: 139165 - DNA, 1155 bp, Homo sapiens
gcaactttcgcctcctgggttcaagcgattcttctgcctcagcctcccaagcagctgggactacaggcacataccaccacactcagctaattttttgtatttttagtagagacagggtttcgacatgttggccaggctggtctcaaactcctggtttcaagtgatccgcctgccttggcctccaaaattgctggtattaccagtggagccaccgcacttggcccatttatgcactttagaaacaaaacctaataatacacttgtcccctagtctttaaggaatctcaggggggtagagctggtgatcagggagaattccagagatggataataggaagaagttgtagttttgtgggcacaacaccaggttcaagcaagcatggcagcatgtaataaatatggcagaagtctagtcatccaatcacctctagtctttctatatactggacattgtgttctgttctatagaaaaaagatgaataaaataaggtctttgctcttgagttcaaagtctaggtggggagatagacatgtccccagtcagtacaatctgattgcggctgagaccaccggactgtggttaagagcctggattcctaatccaaggtttgggggtaggactgtaacagcagcagcaaggcagtccacaggagccagggttctggccaagaaaccaagacagggactcaggcgagatacagtatcaagacagaggcagaactgctggaattgactaaagtatgtaaatcacaaggaattccaaaggcccagttattgcaactgggtaaaatgtcagagcaggactagaagacttgatgttgaggggtgacttgatgctgagcactgtgtatcctaggagcttccttaggttaggagattaccatgagcctaggtagggctggggtactatggggagtaataagtaggcctcatctgtagtcattcaagaaaatagtggcagtgaagttgagttagtttaactgtaaaggcaaagctaaaaagttctatgatttctaggagactaaaaaaagaaaaggttatttctgacactttataaattgcaccacttaagctgttggttagtttggaccaatgtgtcctctaaaatccttatttgagtggtgagtccccaagtaattgaggcagagggtgcta

SEQ ID NO: 139166 - DNA, 1838 bp, Homo sapiens
ccatgatgcatttcaatctagttgaactccaaacagactactggcactgtttttttctcaaattggactttcctaatgtatgcagctctaatggctctctctaaacagtctttccagaatgtacttaagaacttttctatttttgctttttgaatttgtagcccgccgtattacttgcaaagccattcacatgtgctttgtttctttcgctcttttaaaaatgacaacaaaaagcgatttcagaaaaaaatgagcccaaacagactagattgacggtactcatcaagttactacccgtctcctgacaccataataaccatatttcagagttgtgcatgcttgatcgttacaacagagtagatgaaatcagatttagagtggggcttggaattctctgctcaagtccacagaaatctgaaagccctagtttgtaatctctaatatctggtctagtctggaattcacaaaatattgcttgttctctgtgttgaagaaatggacatttctgtgatacatttagtaaagccctttggctctggggaataagtggatggtggaggtcaggtaaagccaaaatagtcttccaatcacatgacaacataattatttttatcggacgcaaacgctgaatttggctatttgggcatgttttagttattggtttttgcactgtgtcagtttccccaaaggaaccaatctttgggaagccaaagaaagaatggattgaagataccacagatcaaataaagtgcaaggttaatcggtcatctctgttcaaaagggtgctgcaattctaggtaactttttatgtcagtcagaaagcaggggcttccttccaaagtcattcatgttcctttttgttgacatattgactcatcaggacacctggaaagctgtagagcttatccttctagacaggtggctaaatgaaggtctagaagaggattctttccatctgtagtctcagactttgaccttttagactccagaggttatagctatctgaagcccctcttaagttaccatatgttctcaagcaagaagaatgagagtcacaatcctatcagagagaactatgctgggcttgcatgtgagtgaagaaagaagtatcaaggagagcttctgggacaaggaatgcctaaactgtagctttaagggtcaataaaaatttatcatgtaaaaaacaggcagggagtacaaaaaagggaatttcaggcacagagaataaacagcacgtacaaaagctatgtagcactgtatactagatttagaaagatgaatatgatccaagccctgcccttgtagacctcacagtcaataggctacctattctgacttcctttcccagtaattaagatggctttgtcctgatggtggatttaacttcaagcctttggcccagaggtagcttcaggacttttttttgagacagggtctggctctgtcacccaggctggagtgctgtggtgcaataatggctcactgcaacctctgcctcctgggctcagaggattctcccatctcagcctcccaagtaactgggactacaggcatgcattaccacttccagctaatttttgtattttttatagagacaatgttttaccatgttgcccaggctggtttcaaacacgtggcctcaagtgatcctgctgccttggcctcccaaagtgctgagattacaggcgtgagccaccgtgcccagtccaacttcaggatcgtgcaactgtgcagtcacacaaagccctgcactcagaagcgcccagtgcttggtttaatgttctgccattgccatcttttaaaattctaaatattttttgaataaggggaccacattt

SEQ ID NO: 139167 - DNA, 1041 bp, Homo sapiens
aatattccatctctgcacagatataatatagtatacctattagatttttgtgaatagagcagatatttgctagggctcattacttttatttatttttactattttttttaacctccatcaccaccaccaccacctaggattcattacttataaaaaaaatatgtagtgtgaagaaaaatggcaaatgcagagtggtaaagttttataacatatttttgggtcaatttttagaaattatttttaaaagaagaggcataaggtagggatgttagaattctagtttgtggaaatgcaagggatcttgacgtgcctctttttgaaatattatgttaagaaaaacaacttgaaatttagacttaaagaaggaacaggttggagagtaaaagagatgaatttagtgttttggccttggtatatttgagatgcttctgagacaccctatgggcttgtctggagctcaaaaaaaaaaggtcagggctggggagagattgaggaatcttccgaagagagcagagatgataccctaggatgggatgagttagtatagatgtcttgaaacggttaaagatacagattccttgggtcctgcctttggagattctgattcagcacatctggaatggggctcgatccccgcctcttccttaacaagctccccaggccattccgatttgcagccaggttagcgcattggctcatctatcaactcaggtcttggctgttgctttgttgcctctaaaggggatcataaaatgtgaaagattcttctcctgttctttcaaaagagggtagtttccaaaacaaagcaagtttgagagatatattttgaggaaatatttgtgaaaacaccagaaatagtggagccacttccatttcaatcttctggatttgatttgtttgtccattaaaaaaggggggggtaattatttgtgtgtctgtgtgtgtgtgtgtgtgtgtgtgtgtgtgtgtggatttatctcagacattgaatgggtcatttttttcatattttccaaagtcacataaataataataatttta

SEQ ID NO: 139168 - DNA, 1887 bp, Homo sapiens
aacaaggactcgcagaataaaaatactgtcagatcctaatggaaatatggatgtgactgatacagggcccttaatgttgaggtcaatatctcactccccttttatgtatagctcaataatcatttgttgactgaatagcattgctggatgccgccattgattctgcaggccaatgtgagttcttcctttcatttgtctaatgactctgagtaggaggatgttctgtggccaacagtaacactgttggtggttgttttaccagagactggaaattggattacaaggatcaactaggagtctgggaagctgcaacaaggatcaactaggaggctgggaaggatgagaggtggaagtatctctagctctttctcactgtcctccctgcttttcttcttcctagtgggtccttatagtgaattgatcaccctgatacttttcccctcctctccaaataaacctggatgtctaggcaaactagacatttggcttaacaagttatgaattttaacaaatgatttaaaaggaataccaacataactaacttcattgtaagtgaacttcctagaaaggaggcatacaaaattgcataaatatagctgtggattggtcaattatttttttccctgagtcatttctttctgcactcctcatattcctcttgcacacttcgtatagttgatgttttaccatttggcccttattttggttcacttcttctccttattcacatatgcttaacagtttttctccattgtctgtctcttttccacaccgttgatcttataacaaggatatgaataggaaaaagagaataacttgaaagatgggttaaaaacaacttttctaatgcatttggaacatgcctatgtctatatatgtgtcttgtccttgtatttgagaatacctaaagccaaaactgtctttttattatgtgtgaaatttcattttgtgcattatgcattgtttgtgggggaagatgtacaagaaactgtaggtggtgggattatacattttcaaagttagaacaggtatttgtttgttttctgtttttttttttaaatactcatgtcctgggcactttaaatacattatctcatttaattctcacaaaaatctcatgaagatgtggtatcttgctcatagtctcacagctagtaagtggtagaagtggaattggaatgcagatttgtctggctccaaagctccagactttttccatgacaccatactgcttcaaaatgtgaataattctgggtcttctacttcctgatattatagcatataaggaccaggcatatttccccactgagctcagtgttcttatattgaatttctttatatctcaaagtctgttgaatagtttttctatttagaaagcattctaagctttgagttgtattttgggatgggataaccccccattttatttccccaagacatatggagttctttgaaaaaatcaaactgtcatttgagactaagaaggaaaggaaagtcagagtgtgttaaatttccctttgtctcaagggcatggttttcattaagttctttgccttttttgtagggaacaaccctgtgggcctgggtgtatgtttaatgtttgcttttatgtggacctggtcttcttcctattctcagggtcctgtcatgattgcttcgtaatagtgtacccaagtcatggtgatgtcactgtagtgccttagcctttggcatttggccagtattgttaacagcgttgtcttatgtttattctgatgttgctttggtccagcagaaatgcatgggaggcagggaagctggagatgacactgcactggaacagtggttcttcaacttgatcttccttccaaatcctctggagggcttggtaaaacacagatttctagg

SEQ ID NO: 139169 - DNA, 1027 bp, Homo sapiens
ctctgattttgacagaatgtagcatctcaaacaaggcttacaagggttacatgctgtccttaattgaaactgtttgtctctcctagtgagcagacaagcctcagttttcggaaaccacatcagcagatttcattccagggtggggaactatttctgacaaggagccccgcaaagtatgtgtgcttcagagaaaagggaaaactgagtaaacaaatactccctttgctgaagggggatgtgggttgaaaatcatattatagaggaggtatcctggagtgtcctgagtaactagccaaaaatttgatctggtttctcttagcatggggtaactcaccatgccaactgacatatttctccagtgacctcgacatccgaaagtgtcccctgaaagcacagctgtctgttctccatgcttcaagcctcactattttccctaatagcctgcaagatgccattctgcagatgtttcttcgacatttcttaacacaagggcatattaggctcctttacatttctgacgtttgtacgattgaaatcccctcctggaaatccggggttgcttttatatgatgcaggccatccatgcttgagaagctggggccttgcagagcagcatcttaatgccattcacccaccatttccaccaactgcccaaatctgggtctacattaagttgcaatttgctttctcaggatattctagtgagcagagtggaaagaagaaacattggcatgtcctccagaattttaactaaccagagggctgtctgctgatgggtgctccgtgcaccactagctccaaacctttactaattatgcaaactcatcaggaatgtcacctgatgttcttccatttaatgagtggttgtgcaccacacttcattcattctgcatcagaattattgacatgatattgacattcaagggcaagctggttttctaatgcttgccagagaatcaaagtttttttatttcctaactttacctatcctttcagaaaacctgagaatgtcattgatacttaatgc

SEQ ID NO: 139170 - DNA, 3409 bp, Homo sapiens
gactgtataagatatgtatctcatgctgccctttgcattcttgttacaactttcattcttgtccttagggttggaacatttatttctcttcagttacatatattatcatggtgacagtgttaacaaatgtggtgtgaaaaaaatgaggtttccatgtttggtttctaagcatttcctgaccaggcatctaagttattattggcttcctcattgtcagtgggattatacagttctgttatggttagctatgtggcccaaactttatttcttagtgaccggagagacaatgaagataatagttcaggtttaggttagactgaaaggactgtagtgtgattgaagtaatggtaagaatagattttggaaccatatagattatggtttgaatctagattctaccattaaccatgtataaccttgagcaagtttacttaaactcactgaacctcagtttcattatctttaaaatggagataacaaactcacaggattgttgtgaagatcaaatgtgatattgtttatagcacacttgtcacttagcctgctattgatttacagagaggctaagtaacttgcccaaggttatattgctggtaagtggcagagttcagtctggaatccaagtctgcttgatttcaaagacccatgtttattctactgtgttttgttttgttttcccatttataaggcatttgatctgttattacttagaaatatagatgcttagtactggaaggaactcaaatgtcatctattataccactgatcagatattcaagtttccttcacagcatatctcacaaagccctgccaagattcaagctattcttgagcaccttagtttgtctatactttgcataatttttgctgatattgtactctatgtcaaagattgctgtcatttaaagtgtctaaccatgtttatattatgttggacaggacaccagtagaagggaagggactgtcaggaagtatgcaagtagaatgggagtctagtttaatgagaagcccctgacgccgtaagtgttggtagcaggttaaaaaaaaatccgcttgttctcactcacaggtgggaattgaacaatgagaacacatggacacaggaaggggaacatcacactctggggactgttgtggggtggggggaggggggagggatagcattaggatatatacctaatgctaaatgatgagttaatgggtgcagcacaccagcatggcacatgtatacatatgtaactaacctgcacattgcgcacatgtaccctaaaacttaaagtataataataataaaattaaaaaaaatccatcagtagagaaaaatcaccaaaagggtctccagtctaggattctcctgaactgatttcatcctaactttccatgttatgataaacataacatggaaacataacatggtttggggtcatggcacagcagtttcagaaataactgctttgacctgcacccacttttatttttactgaaatagggaatcttctcagattcccacagggactgggtagccgttcattgccatagtgcagacagctataactttacaacttgctcagagtttatatggcctaccactctattgggcttgttaaactgggtaatttgctttttagcttattataacacatattctattctgggggacaaccaatctattgcacttttcattacctgttgttcaataacaacacctaaggaattcagggtgtttggtgctggagtcctgctttaaatccttatcatttggattacacagctgatcagtgctctgacttctaatagttagactaactctggaaacacctagctgcttttagaccaatgtgcaagggtgggtggctctccattctcagctcatttcaattccttatctcagggagagggccatgcagtctttttggatgtcgtaattttaaaccacttggaataatattctcctttgctttaatgttatacatccctgtgcatgttcttcagtaattgaaagggatatcgggcaaatttgatctgtctagctttgacttatgctgtccttatcttggcctttgtgtcattaagaaaaaaattggtattgatcttggaccataccactacattgtgctgcaatttttcttccttgctagtggaatataaatcgataaaaggcagctgctttacacgaaggccagatatggtgccgtcatttatatattgtaaatccaatgatagctgatcaaatcagtgcctctcctgttccaaacttgacatgattgaattgtcaatagaaaagattttacagtaagagaaggaaagctgacagtgtaaatgtctgaaaacccaatgaagctcaatataaaataaaacaatgagctaggatatcattttataatttccaatggggaaaaaaagtgtttagtgaatcacagctgaaattgggggtgatcacagggagggggaagcaggaatgaaaagccagctaacttgcattataatttttgagaaatctgaaatgcaaatttgcagatgcaaattttaggaattatgcatcatagtcactgagttgtttatttacagaaatggttcaaatactctccatctctttcctcctccatacacatagtttttagtgataatacccagttgctggggagaaataagcctatctttccccaggagtcctgctgacttctagtaagtggcttgggaacaaatcttgtagaacttatccttgcattcttaaagtcaatcagtagagcactagtttcatttaaaagatccctagaaggagtcaggtttgtttttgtttttgtttttgtttgaagctgcagaactttctcagatatatacatcttgcttcacatgtggccaaccacacttcccttaggaaaactaaaaaactaaaaaagctgtaccccttaaaacttgaagaactcctgccaatttttcaggatacctgatttgtctggcatcactgtaatacaaagagggttagcaagcaaggatgctggctaagaacaacctcaaaagtctacacgctagaagaaaaggtcccaagagaaggtggtaaaaaaagtaagaagggaagaagagaggagggataaatcctagaggcaatggtcatgtactagatatatgggggaaaacagaggatggcttggaggagaataatggtattatactagcaaaaagtggacagaggtgagatcagtaaccagtttgcagcgaggtgatacaaaaatagatgttaaatgaagttttagacatgtcaactttcggggtacaatggaaactgtgcaatggaaaactgaaggcaagagcctgaagatacacctttgttttgtttatgggtccctaattaaacctgtgaactcatgccccagaaaatgtatgcatgtagatgcatgaaattttgcat

SEQ ID NO: 139171 - DNA, 1052 bp, Homo sapiens
ttcaatcaaaccaaagcaatctatttcaacacaatgattttgactgtgagtgacaattataggattattaatactttatttgtaatatgttttcctagcaatgcaaaattccagggtcaaaaattctatattttcctgaaagttttatcaccaagcaacaaatgtttctttggcttctgctcgctatttgtctaccataattttcaggcccatgatggatataaagatgaataatgcctacactaggtattattaccttttgttatgtggatgagggagctgaggcccagtcagacgttactcacctagtaagtggtagaaccaggcctccatttcaagtgttccgaatatatatgtatctctatagccccagcttacctctatcaagtacataatctgagacaaaaggaaataaatatttcaacagtttgaagagtttgaacagaactattcatgtgccagtattcccaaattatagataaaattgactgtgtaaagattgtgacactgttgctccttacttttatggaccacttaagaatgtgccaggattatacagaaattgaaagtattaataattggctatagtatttaccaaagttctttttccttctgatggcatcaaaaagctaattagtcaatggagtgcatatgtcattggctggtgacttttgtaataattagtgtacatttatgcttccaaaacaagctattttgaggttacctttgatcattaacttaccttcattgttcattcaccaggtgttgaaaaaaatgattctgttgaaaatgttgctatacaggtgtgtggctagaaagatcactttgtatacacttgaagactttcatcctttggcttttcggcacaaccccttttgtggaactttaagaaatgcatggagctcttgctatgtgctggccattggactaagtttctggcatatgtttcctcagtcatacctttgaacacagtcagtttgagatcctagtgctagatggccaaatcacactcttgtactatctcccatctaccagctatttgctcctctgtc

SEQ ID NO: 139172 - DNA, 2193 bp, Homo sapiens
cccagacaaattttatcctgatatttattatatggtctctcatgtgaaagataataggtagtagtagacaccttcaactatagttttgcaaaggaacaataaccctgttaaaatggaaaattcctgtattgaccttctacataagggttgagtgtgtaatattaaatcataattcagtttagacatttctttggaggctgaaataatacagtcctgatatgtggctttctgattatttaaaatatggaaatagaacttggagaatgtggttgatcatctagctatcatgcccactttattctttctttctcaagggtcagatgcctcaaggggaccattgcctgactatagcttgcataggaatcatgttggaaatcttggtcaggtaactctaggacccagggtctaggtttatccatacactttgagtaggtgttcgataaaattttgttaaatgaataacttaccagggtccacagcctggacagacactttcctccctcttagtactctctctctactagggagcaccttacgtgaatctgcttttttctccatgtactatctgactactctcttattcatttctcagtgatctcctcttcttccttctcttttttaccatttccacccttgtgcagtctgcatctgccatgttttggacaacagctgccacaaatacaatttgaatgcaaatacaattacatttcaaaaattactcctaccatattgcaaaaaatagaaaacaacaatcaagaaaagactggttaaattatgaaacagcaatatgatggaatactatgcagctgttgaaaagatgttgagaagatttaatgacatgaataaatatccatgatatatatttaagtggaaaaaactgtgtgtgagtatacatgaatttcttttgatatctatttttttctatccacctatcatttattgagagagtgagacatagagacacaaagacacacacacccagagacagacacacagacagacatagacacacacagagagtgtacagctttaggtggtaaaattaaaggtgattgcatttctttgcattttgcttctctgtactttaaaatttttctatagtaaacatggattatttgtgtttaaacaaaaaatataaaactccttggcatggcatacaaagccttttaataggcggtcagtgcatattcctctagcttctgttttaatattccctcatcctttgttatatgcgttacaaactccagtcacatggggccacttgaatttcccccagatgctctgggatctccctcccatactagactgcagactcctagtagcagttggtggctgggttgtggccctgtctgtatcttttccacttagtgcagtgcctggcgcttaacaagtgctcagcgtctgtttgttgaatgaataggcaatgtatcatatactcttctctcgattttaatcagaccctccctcctccttccttgtcactgatgcacttctgctgttcaattatcaaattatggaccttatatcatatgttaacatgggtttggagatagtcagtgaacatgtccagagttgtttaaccatgaaccttatatatatgttcatgcccttatacattctttagcctctaatcaagctcattccctatctatttcatgaaagcacaccttcattttaggacttattttgaacacataaaaagagatgatcgtaagacatcctaactataaaaacctgcagtatccatttccctcctgaaaaaacatatctggctctgtttcttctaaaagtaaaattagaccttgcagagatggtacaatttaaacggcaccacccaattaatttttctggccaattttatttttgaaacaataattaaacatggtcttctgtaacatctattctttcttttccccaaggagagattttgtattattttccttttgtctttgctcagcactttggagtgtgtgagttttcattaactattctgaatgcaggcaaaggcaatgtggtaggaacaaacacaaatcaaggccgcataaattaataatctttttagaaccattgtcctgtatgcctttagaaattaattttaataccagcaaacaagttcaaaaattcctccttctttagctactgtaagaaactcaaacttcctttggcaattttatgaatgataaaagctcactt

SEQ ID NO: 139173 - DNA, 1055 bp, Homo sapiens
ggcctagtccatccttgggagttgctgctgacaggacaaagcaccatagtcatcaccatcattactattactcttgcctggaagaattttgtcctcatcttcccgaaacagaaagtccgtactctgcacctgactctggtttagccaggagatttgggaggatgtaacttggtcaccataatttggcttgtgacttgagattgggggccaatggttacaaagttaacatgctaatttggtttactcctatctctcacttaaaaaaaataactaacttgattgaagctttatgtagctccagttcagcggttcaaagctttgaagggaaagaccattctgttggaaggaaagatgtggaatttggaagctcaggccaactcccagtccctgaagaaaaatgggtctcctgacatagccttcaataagcttctgggcaaaggggccatgaagccagccaaaagatctctgtttatctgccacattttcttcacataggtagaaatattatctttaaatcagcaagctgtacaatctgaaattaacaaaaaatattgaattatagagctgtgctgtcatgaaaatccaaaaattactgtcttcaaagttttgccttaaaaatccttttgttttcttgccggattctaggaagttcaacatgagaaaaggctgtattgtcagattgtatttcatggactcttaaagttgcaaggaaccttagagctctgcaggccagcctggcccccagggctaagtccttgctgtaacttcttgtcagaggatcattgttcctctcagagaggtagctggactgggcaaagctctggatctgtactaggctccgccactgatgggctgtgagactttgtggatatcactacttctctagcctaggtgtactcagacctaaagaagagagaagccagatgatcttttagtgttctgctagctctgacatgcctctggtggtctctaaattctggaatgtgtgaatatttgaacattttgaaaggatgattttttttcctgataatagaagtaacacgtttattttagaa

SEQ ID NO: 139174 - DNA, 1032 bp, Homo sapiens
tgagatatcttaaatgatatagatttttataactggggagaacaaaggaccaataccagtcatgtgcttgagaactaccatatcagtgttgatgactcatttgctttcacccaaacgccctcttgagtcctttaaacttttttcccttcaactttattgaggtataattgaccaaaaaaattgtgtatatttaaggtatacagcatggtgatttgatatatgtatacactgtgaaatgattaccacaatcaagctaatgaacacatccaacttgtttaaaataagtctattatcccaggattcccagacccccctgataaaagtcctgggtcttcctgcaaggcatgctttaatacagcttcttcccacaagggggagccaaaaatgctttgggggctaggagatgaaaaacactaagaggttctgaaaatcctgcttcctttctggtttcttttgccagtaaggcccttccagcagtctccagaaaggaaaagtagatggtgttgctgctgatggtagtgtttttgtatatggacatgggatgggggtagggggcttttatctgaagaaacttgatcctgagagataaagtccttctgagcaaccagtcagcactgtattctcatcacctatttccttctcctgctggaactttgtcctgcaaagctgcattcttttgccaccgtgtgggggaattggatcagctgcctgttgaagtctgctcccttaacactgggtcgataatcttgccccatcagcccattggagctgcttctgccacctcccgctaagggtgttaaagaggacctggtaaaaagacttctactgccttctttgcagaaagtgggtagatgttgggggagaaaatcccatgtgattatggcctttagcactgctttaactttggtagtaccaatatttcagttaagccaggagcaagaagggttgctgtggctttgacagataaagcaaattactgaatccacatttgaagaagaaatttggccccaaaccaggagtatgtataaagga

SEQ ID NO: 139175 - DNA, 1118 bp, Homo sapiens
tcaaaaattattttattgggtattcttcaaatgtggccttttacaatcacctcttgtcccaacctcagcataacttcagctttctcctttgacctactctgtctatataatgccctggttctgagaagcttagactaaaacttttgtcaaaggataggaaaagagcatggtgatgatggtgatgatggtgatgatgatggtgatgaagatgatgatgatgatgatgatgatgatagttaacatatagtaattttcttctatgtaccaaatgatgtgctaagtggtctgtatgcattatctcatttaaccatcacaacaacctcgcgagataggtactactatctttaaccccattttagggatgaagccactgaggctcccaagatcacacagtgaataagatatgcattcaggttgagattgacacctgtcttactcaaaatctctttgtaatcccttccaaaccccctcccctagcctcaatcaccttaataagtgctgtataccttcttaaaggatataatactgcctaaagtcactgagttagaggaaactccaaaggtcatatatatagcctataaacctacatatgtgagatataagacactatagcttctgctgttactttagtgtcctctctaagttgaaactctcaacagctcagtgaagtatctataaaggatattatcaccacttaggggatatgtgacttgccgaaaatcacccagtaagcttgtgatagagctcgaactagaatctaggcctcctaatacctagttcctttttttccttctattttagtgttcaaagttatgagtatggaaccacatttctaattatcattagccagaagatacacatgactgttctgagatgtctttttttttttttttttttgaaacggagtctcgctctgttgcccaggctggagtgcagtggcgtgatctcggctcactgcaagctccgcctcctgggttcacgccattctcctgcctcagcctcccgagtagctgggactacaggcgcccaccaccacgcctaatttttcttgtatttttagtagagacagggtttcaccgtgttagcagggatggtctcaatctcctgacctcgtgatc

SEQ ID NO: 139176 - DNA, 6579 bp, Homo sapiens
gagactatataccataaaggaaggttgtgcctttgaactttatgcttttaatgactttcatgaaaaaaaaattaatcagtgtcactagaaatgctagatttgttgtctatttccaattgatttcagtttcctatgggaatgtgaccagcattgatattcttgcagtctatcagcatgcatgcttcaatgctgcttttgtttggtatggccacttcagttggtttatgtgaagattgtgtatctcctagttcatcttccagtccattacccttctctatctgtgtgctctatgggatgaattccacagaacgttttaggaagcagggctatgatggatttattttaaggtaaaaaattatttctctgttttttccttgaaccactcccccaactccaatctcttttctcagtctcactctatatttctttaccccccaaaacaagcatagagtcagtaaccataaagtgtcatttgtctctgatttaggtttgagtctgaactaattttgaattcttggctgtaatggatgctttcataataattattggcagcacctctttccaccttagtttttattaatactgactgatcttgtgtaagaaatatgaaaaatatttccctttcctctatcacttcatgtatttgaaatgacatcccttctctcttccttcattgaagtggcagcattgattttcttttgttaatctctgcttctgttttcagaaacaacaatcagacacacatccctgcaaatagctgttcttttgtctcttctaaatagtatttttaatacaaatttattttcctatggtcagcttctcttgtacattaatagaagcaggcaccagttctcttgtacgttaatagaaacaggaaccagagaaataactcaaaatattagtcatgattctgactcccacccaacaagtcaggcactctgcattgcacttattttctgtaagtgggcaaaaccctgaggattaactagttctagtttggaaaacagttaattcatatgtttgagcatgacttatgaaaaatttcctgtttgtagatacgtgtgtgtgctcactgttgtaaaagatctttctttcaaatctgaaagccctgagctggagagctgtcatggaaaaaaggcaatggaaaagtctcctaaaattgttccaatttaagtcaacttgctccatttataaaactgttatataggcagtcggatgtctgctttcagcaagtgcatgcgcagtgggacctgaaattgagagcatgtgaaatccgcaattcgtatgataagatattcttcctgaataatgaaaattgcagtagggaaacaaaccttcaagcaggaatcagctttttaagcatttttttttaaaaagatatctgtgcccattatgaagtaagagagcgtaaaatgtaccttttggcgagagaaacaaaaatactccttactacagatggcaaactgtagacaaatgccctgtatgtggtatcacatgtaattatatcattttgtcttgaaacattttatgagtttgccttgctggatgtctgttgtctttatcttgtctcatatgcatatactcagttatatgtatgtatacatataatttgattggataaatccacctaaattaactactcttggctttttctttgccatgtggctggaggggtcacatatttgagatttcaaaataaagaacatttaaggtatcagtggaaaaaacttaggaaaaaaatctgttatctgttcttataaggagaagttcaggtaatggaagattcagagtgaattctatgagcaaagctggtttaggtgatgaagtttcaattgatacaactatatcaaagcttgtggtagcaaatcttagaattcttcatctataactaacaggcacaaagacaatatagtatgcatttattagtactgattaaactacaaatataagctattctggtggcagttagaaagcacaatgtaaagaaaataaaaggaactacttttttttaggatttcagaaggaaggcagttttacagaactgagtgagttctgccttttcatgttggatatcgttctggttctcatccagactagttcaaaagttcagtataataaatttatgatgactgtgaaaccaaactatttcttcaggtctttggagagaaatatggaaagagtagtggggaatactaatatgtactttcattagctatgtcatgtataaaggaggtaaatattagagtatttgtcattcacttcagaaggatgccattagaaaatgaaactggcaagaagtcttcagcagctcccaaaagaaaagttatgttttcgaggtccagtgtatcattggagtgggaagaggattatttccatatgtgtcagggttagtttgtatttgaggttatttaaaaagaaagaagttgaacctcattaattcagtattctgttaatttgtaaacaagattgcctgagggagcttttaaactgcttaaaagagcaaacttttcaaacactttagaggtagtgcctggtatactaatttcaaacagttatttgcatgtgaggcaaacatccttgctgggcaacattttgttcatttcactctagctatggtatgcacagtaatcctttcctaagtctgaattcccttaatcaaaattatagcctaggcagacttgcatctatgtacttctttcccaccatcatctcaagaattttggatagagatttatacaaatctccattcactccaagttttgaatttgggagcattatcaaggtaccccaaatctaacacctggatggaggattggtcaatgaaaaagtgtctcttaatattttatttgtaacatggaacagtgaatttacaaggatctcattaaaactgtgagagaggaagaccctggaaagtttgtaatcagcggattaagtgaaagttaattgtacagcatcctttagtgctcatttaccaaacacaattgatattctttttacttaatgtgctgtttctgttgctttattttgatgagcattaacaaatatttctaagagttctcttagggtcacttgtaaccacagtctcctaaattctagggaatgtggcattgttcagctcaagagaaaattctgagggagcccaaggccttaggtacttatgtttagctactgggactcactttgatcccagaacactgggacctttttctgagtgtctgagaagtagactttctctttctagttgtattctattattcttgctcgaaggctaaacttttcctaaactcccctcatctttgatgaaagaaaagctttcactcaaacccccattttctgtcctcagccagccacattgttacctcaagcctaattctcattattttgagtcagcaggactcaactagtttgcagctatgcattctccatactttattttacacttttgtctgattcctcgcagttttcagctcctttcaggccagacttcccctttcatttcatctgatctattttaagtgtcatttgtgcttctcctgaccaacaccttatctattccaaattagcatatataagaaagttgtttgtctaaacttggaaggtagcttcctactcccaccaaggaggactgtgaggggagtgcaaaaagggaagtttgtatttctgttccttctgctgttacctacaacctccccgtcttctgaactgggaccctcaggctttggccctggattaggtattttttctatagctcccaccagctgaggaccactgagttatttactctttatctacagtgaagatatttttgaactaaacatggtaggggcatgtggtctaaaaatgggaccaaatattaaaaatcagaatttttccttatatgctgttattcttgtaactcaactatatctttactccactttctataatctccactgtaggtagcagcggagggtgaggggatgtgttgggagtgagagtgttttgtgaaacaagtcttgcctcccttagaatgtgaagaataagttctggtttattcttttattttattttctttacccttcttctttttttctggaaagcaaaatggatttaccaaataaggtttcacaaataactgtactcggtctcccattgatctagggcccctatacaaacagccctggagttgtatggctggtgacctcctcatgctttttcttacgaagaataagtacaacctacctcactagggagtgtccagtcatgtgtttccagttttgttaaagtgtgactgaatgtgtatgtttaaagtgtacagtgtgatcatttgatatacattgtgaaatgatgatcacaatcaagctaattaacacaacaatcacctcacctagttaccgtttgtgtgtgtgtggtgggaacacttaagatctactctcttagcaaatttcaagtatacagttttattaacttagtttccattctgtacattagattcacagaacttattcatcttataactaaaagtttgtaccctttgaccagctattcctcattcctcctgtctcacacctccctttctcctttcaccgagtcattttgtgaaggctctactggccatggttaacttgtccttcctcacaggtttattttgctagccatattctctctttcagaagacatgttgattactcttttcactttctggtgatgattgtcttctgtgagatctattatgtaagactttatctcttgctaaaaggatgtataagctaaggaaagattcctggcaatagctatgtaataaagaacagggaaaaagtacaatgaaatgtattaaaaatgactttgtggaagaaatttttttgtatcacgaaatgcatagttacatagttgccacagaaactttccagatttttaaattattgtctatattcatgagaggtaaccatttgtatagttatctattgctgcataacgcatcaccccaaaactcattgcttaaaacaacaataataatttattatctctcatggtctctgtgggttatgaatttgggaatggctaggttggatgattcctgctggaggtctctaatggggtcatgcattaggccattcttgcattgctatgaagaattatctaagactgggcaatttataaagaaaagaggtttgattggctcatgattctactggctgtacaggaagcgtggttctgggatttgcttctggtgagggcctcaggatgcttccaataatggcagaaggtaaagggagaacaattgcatcacatggcaaaagtgggaacaaaagagaggtagaggtgtcaggctcttttaaacaaccatatctcacctgaactgagtgggaactcacttgtaaccaaggagatggtgctaaaccattcatgagggatctgtccccatgatccagtcacctcccaccaggccccacctccaacattgggaatagaatttcaacatgagatttgggagaggacacacttccaaaccatatcaggttgcaatctaatgttggctggggctgcagtcatctgaaggcttgtttggggctggaagacctgtttcctagtgactcaataacatggctgcaagttggaactgactgtaggtgatgagactcagttcctctccttgtgggcttctacataggtcttctgtaatatccttatagcctggcaactgatttttcccaaaacaagcaatccaggagaccaagatggaagctacaatgtcttttttggcctatacttggaagtcacacatcatcactactgctgtgttctattggtcatgcagggccaagcctgattcattgtgggaggagactatccaaagtcaagaataccagaaggtgtgcatcattggggaccatcttggaagctggctatcacaccatccatatgaatgagaaataaaccttctgagtatctgataataataataataacaacaacaataacagaagctcctacttttctgtcttaataatttctatatagaaactcctagtgtaatttctgggctggcacgcactcctggttctcttctttcctccttgcctttattttgtctatcactttcatggaactctttcttcagtctgcactttcaacatgtttccttagtggcttatctttagttctttattctcactgtacatgctttacctgggtgacattaagggtgctgtattagtcagggttctcttagagggacagaactaacgggtatgtaatatatatattactgtatacatatataatgtattatatataatgtaatacattatgtatataatataatataatgtaatatatataggggagtttttaaaaatttaattattattattattttttttttgagacagtctcactccgtggcccaggctggagtgcaatggcacaatctcggctcactgcaacctctgcttcccgggttcaagcgattctccttgcctcagcctcccaagtagctgggactacaggtgcccatcaccacacccagctaatttttgtatttttagtagaaatgggttttcaccatgttgtccaggctgttcctgagctcctgacctc

SEQ ID NO: 139177 - DNA, 1055 bp, Homo sapiens
acctccctcagaaatttggcagtaatgatctcttctcattcatcatgatacttcccaggctttggagattctgataattgtgtgaagttctgaaactactcttcaaaacattttaccagtgactgtagagaagctaatgagaaacctgtgaatttgctgggtttgaacagtaaagtttgaatttttctttttcatcttaaactgtaaggaagagctcagctagctttatttaccaaaaaaaaaaaaaaaaaaacaaaacccaaaaaacaaacaaaaaaaataccccacaaagtcatatcgtaaagatgaacatatctaatgaacagaattttagtatcttgggccttaaagttataatctcatggcttaaagtgaaggttattgatttcatccatcataatattttgcataataatccagactttaaatgaaagaaatagagaattaggtaagttctgatcagtgaactactgataaggtaacagtttctttaaacccagaagatggctgtagttcaactcattaaacattagcactcaggcagtttccttggagtcagagggatccagagatgagtcagccatgatctctgccctcaaaggacttcttgtctgataggaaggagaagcccaataataatctaaagttgaatatgttgaatgtggttaagagaggtaaagacagccctctggaatttaggcttggtagagattacagttgagttggggcagggagatcaggtgaggactggaccaaaggatcaggtgacagttaagtgggtcctgtctgcagcaaggatcaggcaggctgggcacaggaaatgagatttttctgttactttattaccaggtggaaaagatttgaaagtggtcgaagggaagcttaccaaaaaaacataaataaataaataaaaggaggctgatgaaatagaaatggttacctcttcagctgaatactgatattatggtgaattatggacacattattgttacaccttgacaggtcagtatgggtgtacctccatagtctataaaatttgtatttgaatttcagag

SEQ ID NO: 139178 - DNA, 4003 bp, Homo sapiens
catgatcgtgcctctgctctccagcctgggtgacaaaacaggaccctgtctcaacaaagaaaagacaagagaagagaagagaagagaaaaagaacatctggaatatccaccaaaattaaaaggaaaagtaaaactacctgtagctactccatcaagtaataattactgttaacattctgatatatttccttttagtattttttcctatgcattcacaaagaaaaatgttttattaaaatgtgattatgctgtatatatatagttctatacttgctattttcacttaatatggcatcatgagtatttcaccatatcattatatatagttaaaaacattatcttgaatggttgcatagaattcacttgtgtggatataccataatttcttatggacgcaccatagtttatttcttattttcactagcagtgtataagaggacctgtgtcactacattctcattgtcattgcattttaacttcttctgtctctgccaatttgctagaagaatgatggaatctcattgtttgaactttcatttctttgctaatgagattgaacttttttttggaacaactcagtttttgacatgtggctttcaacgcatactgaatgcacaacttctagtcaaaaccacatatacatgtataggactcatggctccagttgtgacagaacaatgattgccttgctaatatattttatatagcactgggctcagtgccacagccgctaaataaatcataagctccttgacaaccaggcccatatcttaatcatttctgcatcccccataacccccagcctattgcctaacacagtgtaagctttaataaatatttgttaaatggatatggaggtggagcttttgtgagggtcaatgttaagttgctgaaatagcttttgaaatctcttcatgtgaaaaaagaatccctggagtcaaaatttaaaaccattgctcaggcttcaacctatcatctcatatgaccaggaacaatgaagaaacagatctttccataaaagggaacttctttttgccaaaggatcctttttctagccatggtatcaaatccacaaacacagcaccattatgataggggagagtcaaaagtaaagctactagaaatgagcaaatggctacaaaggaaaatgaatggatgagaagaaatatgggggaaaaaagaaaaaaatatgccatctagagctatttttccttcacttttctacttggtaaatagagcaagaaagctgcaaagactagtggaaaaatttttggataaggaaactgaggcttaaagaggtgaactgacttgtctaaggttatgtagcttctataagagcatagctaggactgagaggagtgtctttttcaatgagatcctactcctatcccctacacctcacagcagtgcatcaaagcagtttggatttctccattctccttgccagctctatactttaaatatctatctcttcttgcacttcttacactctcttcttgcacttcttatgctctactacaattatttgttttcatttttgcctccctcaatagattctgttcttcaagggcaggaactgagtcctgatctctataacttcaatatctagcataacgcttgattcatctagatgcttaatgttagttcatgaaagatatcatgttaattaccaaagctgtgttgttatgttttggcattcaaacctgagcatctggaaatctttctagttgaataaatttgccaagtatatagtaactcccaataatttctgctaattgttagggttttgccataagtaaggctgtacttggagaggagagaaatgactactgtagagaaatgacaacaggctagggaagaggaatatgagggaaacagagcagattagggaaaactgaggagactagaggagggagatactggatagaagaagaagatgttatgggaaattagccattagtgttaaccatatgcttttgtggtacgtgttctcatatacatacatatctcacagtaattctttgtgtagtatcacacccactttacagatgggacaactgagacatgttaactgatttgcccagagtcacacagttaggaagtggcagagatgaaatctaaattcatgtctgtctaatttcaaaacctgtatttttccttgtgtctttctaatactccatgctgcctctcactggcattgaaaggaataaaacagaagaaagcttttttttttttttttttttttttggaatttaaaaattgcacgtcaaattaaccaaatattaatgatataccatgtcttcttttgaaactttctcctaaatttccctgatagttctttagcctactttatttatgtaacattacctgtgaagtactctaccagatagggtcaagtagaagttataggtggtaatggtactaatgaaagagaacagcagtatttgaaagcaccaaagttatacatacattatcttgcctcatcattgaggggataaaatgccagcgtgtgtgctgctgttggaagcctggccaccttcagttcacctcctgcacttttgccactctcttggctttactgaacttcccacaagctccatgattcccacttcagcatgctgcttatcttgtgattggcaaaattcctattttttagtttcccacaagcaattggcagctcattagaagtgattagttgctttccaggattttaaacgtttagaatgtatttagttccccaagaatgaggaaatcttgactggatcttcaaagaatcccattttagctgcgtgttttcaaaagtaaagttaatatccatagcagtttattgtacctagttgtctaaacaatgttccagatccaataaagattttctaattattcccatcctcctttctggaggcagcctggtaccagctttgagaggaggcaggaagatgggtctgtctcacccctctacccctcaaaggccttatgaagttacaaattccacctgttctggagaggaactcagactgaataaaatattaggtcatttggtagaatatcttgacttggttttgccttaatgcattttatcattattctacaagaatctaaagctttcttagaaaagtttgcaaaatacagttaggttgaccatgtaagatctaagacctggaagggatatatataagccgtttaattcgtccctctgcttaggtacatcaatacctaaatcataaatgagcgatggtttttatccatttgaaaatatttctaaatgcaggtattttgtgtcttcttagtcagtagtatgttctggtgtttaagtctctggcatggtcaagaagttctccctaatgtttgaattcttttctagctgtgcttttatgcccaattgatatgagcaatttagaaatcctagggagatgcatgacattgaaatttcctgaaaagtactcagagttggattacagtagaaacaatgaagaatcgcgccagcctgcagagatataagcagaatatgaaaatgtatagctgatttcatcatggatttgcatgcaaataaggatgaagcagtctatgggagggggaaaacaacaggtagagaaagtagaacttatactaatgccattggaaatgaatcagtagaggagaaaatttttagggcaataatgggaaataattggaagagatagggcccacttcagagagatttgaggggatagatttttaaatagaaagaacaagattgattgtataacccatgcaatctgcactataacaagtatattgggaagtagggaagggaaatagatacaggaaaatactgactggtttatcaggagggtaagatggtggtatagtacctagagagctaagtaatccactgattttgaagcacaagtaaagaacaactctggtgaaagtgtaattggaatgatgtgcctttataaggccttggcacaatgagaagttacatttgagaagtatccattttgagtgggtattcatgtaggcc

SEQ ID NO: 139179 - DNA, 1761 bp, Homo sapiens
ttgctggcttggggtgtgtgctcctcagctgtcctgtgtcattccaattatattgtcatatggtgagatttgtgcctgatgtcattgtaggcaaggatatagtagaggcagctcatttgtatgttggtgcttcccagttctccatttgttgagatgcttttatcattcagacctttgagacaatccaacctgcttccttcatcttaaaggtgaggaaatgggcccagaaagggaatgtgatttaccccaaatcatactatgtgttggtgatgggaccaagatgaaatccagctccccaggcctctggcagggactcctgaactcatagctttgggcactgacctcatggggtgaaagggaagattatatttctatttgaatgttttctaacacatgaaatttatataggtagttatacctagcaggagccaaagaacaataattttaaaatagttctataaacttcatatccaagttaattaaacaaacttttattgatttaagagaaactggttaatcaagttcatgattcattaataatcaatttaagttgatatgaaaatatttgtggtatgagcaaaagatggaggaaaaaggatccagagaacaggaagaataggtcagaagaagggggatttagagagaagtgttacttgtgtggtggagaggggtagatagaaatttgggagtcgtctgtagagagatgataagaaaagaaatgagaatgggtgagattgctggggataatctaacagaaacattacatggtagataattaaaatacccattaccacttgctgtatatctttctttcctgagttcaaagcctttcaccaatgctatcacatttaccatcacagtatccattagaagcacgcagtaattattgattccctaaagcacacacgagttaagtgacctgacccaaaccataaggagtggagatagggcctaaaagtattgcaaagctctgtggcagtacaacagactcatttaaataatatatgcttgttcaccttagtctttgctacttcatgtgatagtccagttttgcttaatcaagttttagtttgtagctataaagttagtacatgtcactctacaaaattgtaaaaatatggaaaccataacataaaactcataccataatcctactatttgaggaaaattgctattaacattttagtgtagattcctttttctatgcattttaatacctttttataattacaaagatacacactattgtagcagagaatgtggaaaattcaaaaatatattaaaaagagcagtaaaatcacctgtaattttgattacaggtgattttgattacatctagatgcttaatgttagttcattcacctgtgattttactgttcttttaaatgtttttatttttttttaaattttggtcaacaggtatatgaaaggtactcaacatcactaatcattagggaaatgcaaataaaagtcactgagataccacctcatacctggttagggtaactatgataaaaaagacaagagataacaagtgttgacaagggtatagaggaagagaaactcttgtatactgttggtgggaatataaattagtacatccattatggaaaacagtatggagattccacaaaaaactgaagatagaattaccatatgactcagcagtcgctcttctgtgtatatgcccaaaggaaatgaaatcagaaggttgaagagatatctgcactctcatgttcattgaaatattatcacaatagc

SEQ ID NO: 139180 - DNA, 1059 bp, Homo sapiens
acagagtctcactctgtcgcccaggctggagtgcagtggcatgatctcggctcactgcaagctccgcttcccgggttcacgccattctcctgcctcagcctcccgaatagctgggactacaggcggctgccaccatgcccggctaattttttgtatttttagtagagacggggtttcaccatgttagccaggatggtctcgatctcctgacctcgtgatccacccgcctcggcctcccaaagtgctgggattacaggcgtgagccaccgcgcctggccagacagttatttttctaagaagtattcataggacaaaatgttacatggaactttcttttgaaaatatgattccccaccccccaacccaaaccaaatgagactcattctggtttctgtcttctaaaatgatatccttttcattaagatgaatctggtcccaatccaaagtgcaatgatgactgacagtagtgtctagtataattggagcagtgatggaggtggggcaggtaaatgcaagagtggcagaaattaatctgcagtcagaaattaatctgaccccagactaatgctggggcaggagagagagatatatgagagtgccagaatatggtagatatggtagatgccagggcagggtgaaggcatccaggtgggagctgaaatccagccaggatactgctagacaagctgtttttcttattactccagccacagaaagtacctttgacaatccctccatctcttttctagctggatggcccagagtggggaccttttagcaccagcggggacgccttttcctaatttgcacaatagtgccctatgttttagtagtgaccttaagggtggttataggagaaggtggaaagacaagagtgtctatttgatgtaagtgtagggaatattagtgatagttcggaaatttctccagataatggcaagacactcctttagcagcccccctttcctgagtttcccattgttccacttattaaactctgacatatgtcatgccctgtgtacctggatatccattcatcctgatcacaacctgatctcc

SEQ ID NO: 139181 - DNA, 1317 bp, Homo sapiens
aatcaattttttttgagacaggatctcactttgtcacccaggctggagttcagtggcatgaccactgcagattcaacctcccaggctcaagcaatcctttcacctcagcctcccaagtagctggaactacaggcacatatcaccatgcctggctaatttttctattttttgtagagacagagttttgccatgttgtccaggctggtctcgaactcctgagctcaggcgatccacctgcctcagcctctgaaagtgctaggattacaggcatgagccaccgtgcctggccaatcaattttttaaaagatgacttaccatatgtgctagaatatgatgatggttgagatactcctcaccattgattccataggaccttctacagtgaactttgtaattaacaacagatctactgtcaaagagatttgagttagaatcatagctccactctctcctagctgatcagctctagagtaatcagttcatctgtctcaggcttagtttattcatttttagaatgagaataatgatagagtcttcctcatagaaatgttattaggattaaataatataatgcattcaaagcacttagcacagagcctggacgtaagcactcattaaatgctaactgttaacaagtttttagtggtcatagtttttcactcggtgttccccgagtgctgttcagttttgttctccctcaagagggctgtgaatactttgaggaaaggatttttttttctgcctgattcccctttgtattcttaccttagcccagtgagtgtttcgaagtgggaatactgagcctcagtttcaaaatctgggggaaaaaaacggtactaataatggcacttaacagggttgttatgaggatttaaagtatttgctatgataacacatgaacgaaagcctcagtgattcacatatcctacgatgcagcggtttggatatgatttgtttggtccctgccaagtctcatgttgaaatctgatcccgtgttagagttgggcctggtgagaggtgtttgggccatggggaaggatccctcatgaacaggcttggtgctgtcctcaagataatgagtgagtttcattctgttagtttccagaactgattgctaaaaagagcgtggcaccaccctcctcctctctcgattctgctcttgccatgtgatctctcctccccttcaccttccactgtgggtggaagcagcccaagtccccttgcagaagccgatgctgataccatgcttcttgtacagcctgcagaaccactatccaaataaacctcttttcttcacaaattactcagcctttataa

SEQ ID NO: 139182 - DNA, 1741 bp, Homo sapiens
actttcaagattatcaaaatgttcattcctagttagagagagaaagatggcatcgttcttcaaaatgtttctgttactatgcttaaagaaaatatttttttccttagagcattagttggagtattgagactcagatttatggctattctattgacaaggggttattgcaaagatgttttatttgctgtttctaggggcttatcaaaaataattgactagctgtcattttctacatgagaccaattactattgacccagctttgcttattgttttcattaatgtctaacaaagaatgaaaatgttgttgaatgttcttagaactgacaagagaaaagcagtgctaagaagtgagtatgtatctcttggccttcccagtgctgctaagcagagccaaagctcgatgccaggatgttgtgtgagcaacggcttctacagtatgcaaactcaaaactaccctacgtgatgtttgggagaatggaggatatggagaggtagcagcctgctatgtgcagttgtacaggttgtgctctgcacattcacattgtggttcatgtgaaaggcattctctagagttgtgcaaggcacgaccatatgtggaagcctgggaggcagtagaataacttctgtgtcttctgtgataagtgtagtcagtattattattattattattattattattttgagatggagtcttgctctgttgcccaggctggagtgcagtggtgcgatctcggctcactgcaacctctgcctcctaggttcaagcgattctcccacctcagcctgccgaatagctgggactacaggtgcccatcaccacgcccagctgattttttttttttttttgtatttttagtagagacggggtttcaccatattggccaggctggtctcaaactcctgaccgtgtgatctgcccgccttggcctcccaaagtgctgggattacaggcgtgagccaccacacccggccactatttttttttttttaaaggaagcaatacagccatgagatggctatcatttatgacttggcaccttataaaggtaaaggtggcctgttttacctttgttatgtggtctattggctgaacattaaccacatatttacgcatctttctgttggcatgtaggaatgattgcatttctgtagtgggaggagcctggtaaatgatttttttggcatatgcagattagacagaaagacaggtatgacttagtaaataagtgttccattcttcaagagtagagtagacagtaacattcctcaattattgagtggcaaaaaaaaaaaatcccctttttctaaaataccaagattgtactcaataaagaggaaatggaaatgcaagcaccataatcacatgcaaaactaatttatgattttggtttaaggagcttatattaggctgttcttgcattgctataaagaagtactcaagactgtgtaatttatttaagaaaagaggtttgtttggctcgtatttctacaggctgtacaggaagcattgtgctagcatctgcttctggggaggcctcaggaagtttacagtcatggtggaaggtgaagagggagcaggcacatcacatggccagagcaggagcaagagagagggagaggaggtgccacacacttttaaacagccagatctcgtgagaactcagtatcaactaggacagcaccaagccattgagggatgtgtcctcaaaacccaaacgcctcccaccagggcctccaaca

SEQ ID NO: 139183 - DNA, 1051 bp, Homo sapiens
agtttccctcaatttaagtatcattttctttctctccttattgctcacatagaggaaggcagaaaaatagcttcagatgattgtgtctggaaataccagatattgtggtctatttttatttcaatttttcatatttaaattgtctgtataccatagtaatgtcagtagctggctactgcttaaaactagaaatttacatgacaagtaatagttactttaaagagctacttaagctgtttgaaaatgcctccagacatcgctgtagctttgtctactaaaaccagtgaggcccagcattcttggtcgacatgaagtggcttggttgaacttgttggtatacaatacagtgaattgcctgaccctcctaattgtgcttcagacttaatgccaaaatggtgcattaattggatgtgggcttcaggtttttgttaactatcagcttcgttgctgaccaattaccacatgtaggaaaagattagaaaatattctattttactgagataacaaaatcaaccgatttacatatacccatacattttaaagtaagcaaactttgtatagatttttgttgcagcaaccaaaatccagatggatttccccttctaacagtgtattttcctgtgtgaaatgtctcttgtcattattttcctcccgtttcatttaataagaacatacgtagctcattatgaagtaggtaccctatggagaggattgcctgtgactttccaatatgaaatcacaatattttgtttgcatctattttataaaaattgcaaaagtaatttatttggcaaaataccacctgcaatagtataaccttagttaaattgttttgttgcttatatgtaaaaaaaggactcttgttgcttcccagtaccaaaatcacacaatgtaattagttattcccttttagaaactatggttgcagtgataggcttgaatttttgatgacagagggagaaaacataaatattaaaatatctttatttttgtgtgggatacaaataaaagaacatcccacagataactgtaattgcattttattgaagga

SEQ ID NO: 139184 - DNA, 1372 bp, Homo sapiens
cgggggtatgctgggccaaaaggcaactttttgggcacaaaaacaggaatgcctgtccccattcagggccacaggtcttcaggcttgaagatggggcctttgccagggaaccggcctctccgacccagtatttccctgtctcctttttgtgtcaatattatggggatagagaggatttttgagatagaagcctgccctccagcagctgcatatctaggtgggatgaatagatgccaaagactgctctgcttgtgattccataggccccattggattctgctagcggatgacttgttcatgtgtctttctcatttccccagttgcaattttaggaaatactctctttgctctgaaaattgttatcaattcttcttcagccatttattttctgggactagtaacccaataattcaatgtctagttcagtgaagagtcattgctagacctgatagtgatggtaacaaacttcttcctgggagccactcagccatttcaagacacaagggaatcttagaataaacaatttttttttttttgagacagagtctggctctgtcacccaggctggagtgcagtggcatgatctcggctcactgcaaccttcgccacctgggttcaagtgattctcctgcctcagcctcccaagtagctgggattacaggcgtgcaccaccatgcccagctaatttttgtatttttaatagagacagggtttcaccatgttggccaggctggtctcgaactcctgacctcaaatgacccacctgcctcagcctcccaaagtgctgggattacaggtgtgagccactgcacttggctgtaaatgatcttattcaggtgctaaatggtgggctaggagcctgagagagaataattggttcttttctctgtacggttggtcccatagggccacttccatctcttatttacctatgccttttttctagtcttgatgattgactagagaagtttggggggcattgcttgatctcttccaaaaaaaaagaaaaaagccagaagttctttgaaaatgactttagttttttcttaaagaagcataaaatatcaggttagttgggatagtttttaagcagggaagctgtatttcctgtatttgctaagaatattatgaatgagttaacatgttactgtaggttaagataatctagaaatgtatctggaaaatctatttcaattaccttctgggtgcttttagcaaaaataataaatttcaaagaattaagagagtcataaaaagaagtgttatgaggggagtatacctcatttttcaccttcaaaattaaatattcactgtggaattatgtactgccagggtcactgcattgcttataggcattaatagctgccatagg

SEQ ID NO: 139185 - DNA, 1366 bp, Homo sapiens
gcagaggcgtgatctcggctcactgcaagctctgcctcctgggttcatgccattctcctgcctcagcctcccaagtagctgggactacaggcgcccaccaccgcgcccggctaattttttttgtatttttagtagagacggggtttcaccgtgttagccaggatggtctctgtcttgatctcctgacctcgtgatgtgccggcctcggcctcccaaagtgctgggattacaggtgtaagccaccatgcccggccacccagtactcttagaagcaaaataaaaaaagttaccctcctttcccatccttggaaatttcatgttactattctgtgctcattgttaaagcaggctatgccactcaagcttgaaatatgttcgtgttgccatggtttgtgtcagtagtccttcctcatcatgcttatagttgcttgtgctcactgaaccccaacaggtgtgtgacttaatgtagatgctaaagaaagatacaggaaagtatctgttagcactagattctgggtgcgctttcggtgaagttgtacttgtgatatttgctattacttactagggttgattttgcaagtattatgtccaaaacccctgtgttcttcctaggcgccatgtatctgatctaagatgactctttttgtgagcaacataagaagatattaaatgtagtctatattttctgaagtgtagagtgctgtcatgtttacctctagagacacccagtttcctatggtaacttttcctctacaagttttaagtgcatgaaagaaaaggatgggaacaaggaaagaaagaaaagtaggtactgctgaatactggaggaagacttgagctcagggaaagaaaaaggaatatcaggcctaatttcatcttcattccactgaaaatctgtgagagctgtttctagagactttttcagtttcttaccacttctctctgtgtgttattaaaccttgtctgttcccttttagttattagccctaaaaccccttacaaaacctcaaaagggtttctgggcttaagtagatacagatggggaggaggggaaactatatagctgtgttccacttggcagtggcccaagagaaagcagagtcaaagaataagtgttatcagcagaggaagggagggaggaggcccgcccattgaggagaaagtgagggttgacttgagggactctggaaagggcccaggggaggatacccttttcaaatggcacattatcatgaggtcttatccttttcttctggatggaagtcatcctcccttgctctagactttacctgtacccctttaaatgagcctattacttagtattatcttgtatttgttgttgttatcttgtattttagcagctaat

SEQ ID NO: 139186 - DNA, 2005 bp, Homo sapiens
agactttgaagccagtagacaaatgttcagtctaagtaattgtgaaaacttttagaaacaatatctgtatgttccttccttcctcctttcctgtcatctctgttttccctccatccccatccctctcaaggttccaccaaaggcccaaagcaatatgggggtgagaaaaagatggttgggtggaaggaaaaatcattttattatttgagttgctttctcccttacccaagctccagcactgtttgttgcatgaacagtttgagctccacaggaccgtaagttacacttacaaaaacaggaatgtgtctttaaataatattaaatgttttagtgacatcaagatgcttacagggctagtcaggcaggtaagcatataaccagctttcttctacaagaagttttatttgcatcttttaacatccccttgacatttatataccaaggtagaaagcccgaacctcagagaaaaaaaaaatacatggggtttatgagtacttgaaataaaaaattgaactttttcttcctgtcatgttccttaaaatcctttgaggaaaaatgttgttatgatgtgcccaaagacatttaacataaaaggtaactggtgctggatgtggtggtgcatgcctatagtcctagctacttgggaggctgaggtgggaggatcgcttgagcccaggagttcaaggctgcagtgagctatgattgtgccactctactccagcttgagtgacagagggacaccctatctcttaaaaaggtggggagggtggctgtggttacctgccatcatctttaagtttcttgggcattaagcaagctggaagccagtttaatagctatccttatgtcttatgtcttacttttcatccttgtggatccctttggaaggaactaaatgtgttggcaccattttcactatcatatagttttctttctgaatgtgaggcggtaggattctacttatcatgtactgtacagttgcactacttgaggatgatgaacttccactatatatcacctaatcacttcttccatcctactttgtatgtggtttaaagtgtatcatctcttgcctggtatttttaaataatggcttttacatttttaaagggaaattcttttgggggtaccagtttgtggtgatggttgaaaatatctgtctagcatcatttgtaggaaaaggatagtataatgaacaaatatttattgtgtacctgctatgtgagatacattatgtaaagcactgagcatgatgtctctcacatagaaggtaaggcatgaagatcttaactagggctgtagcagtggagatagggaaaagctagaggtcgatgtaagaaacattgaggaaaagagaactgatagaatttgtgactatatggatggggatgagcaagaggaaggaaggaaatattttttactttcagagctgttagtaactgggaaggagcagagtgatgtcaggagtagaaataaggaagttggttgaagcaataaggattgtgggatgatcactacaagaggcaaaatgaattggattttggtcatgttgagtttgtaatacaggtgacctgcttacggggagctgtccaagagggagtcagaaatacaggcctacagctctggagagagattgagacttatagagaaatccaggaattatccacataactcatcataatggaaatcatgaaagcaggaaaatttaccaaagaagatattttagaaaaaagacccagcaaagaaatagagcatgagaatgaaagccttgagggtatgttcatgtggaaggcagagagattgaagaagaagcagtgtaaaatactccataggggtggaaaaggatggaggttagacgtgaccatcccatttagcaactctaaaagtcattggtgacatttgagtaccaaatttcattagagagatgggtatgaaagtcacattgattggagttgaggaagaggatgttgattcctcttttaatatatttgggggtagagtggag

SEQ ID NO: 139187 - DNA, 1090 bp, Homo sapiens
tatatttaaaccagctgtttcccataccactacccattttaatctgttttaagcttatctttgtttagttttaagaagtccttatctttactgtattaggatttggtgaataaattcagttcaccctgccaatatccattcttattcggcaaactgattgcatcccttttcaaacttcctctgtttaacctggagtgtctgagctctgtaatatgcccttatatagatagtatttccacccccaagaagataacagctaactttctcaagctttgttctgtctcatcacccatggggcctagaatagtatgttgtaacccaggaggaaaagtaccttgcttaaactcctggacaccactttgtttatttcaataatttgtggattatttacatctcagcaacattcttggggcttgggggatgtggaatatatatattgggactggcatagtactctgcatttttcattggctggcctgcctggaaacctgcagagttgtctgtgataatcgttcattggcaaaagaatgccgaaggataatgtttatgcctggcaccatttttaattcatttgccttgagtttaacttttgtagtaaacttctgggatggcagccttctagggcccattaaccagagtttagaagactgtgtggtagaggtcttagccgtctgttacctgtacagttcctgccagttagatgactttcactagggctactttatgagggtataaaaacttcttagtaaattcggccttttattaggcactgcatagcccctatttcaggaaaacggtctgtaccaggaaatataagggaaaggaaagacttttaagctttctttgtaggtgccttttaaacatgttagccatcttggcacttgccactaagtgagggaggcagccatcattcagaagagatggttttaacatctgtggtttggggacacaaaatgagacagcatagtaataaatgtcctaaccccaggtcatttaggtcagacatgtttcttctagcattggtgctggtcctgcctgagactgcaggaatcagtggcatcaggagcttcttcagcccatatagaaaaat

SEQ ID NO: 139188 - DNA, 1091 bp, Homo sapiens
cttgacacattatcttgttttctctttttctgtcttggccaccaccttcatctgtcatgttcttttaaaagcaagaccctaaaactttaccttctaaatcaatattctaaggtgaattttgtgatgctttgaattaatggcagagaaccagaagtataggcaattgcaaatggaagatgatgaataactcatttatatgtgagttggaaagcctgtttatatttacatttgactatgggtgagtctgttttttagaaattcactttcaaactaaataatgaagtcatacataaaggtctgacttgagctgctgagaggctggcccaatttcctgcaacctgctgcatgctggggagagtaaaaacatcgtctgttgtccaacctattactgacatagcatcatcctaagtgctactgacatgtgtaactgaaatattttattctgtggcttacagctgtttcttcttagcttgtcctcaataaatatggaagggatcatcatggtcaaaggacttaaaaaggaaaagtaggatggttgtgtacaggaaactatagcaaaaatatatatatgtgcataaaatggaaggattggggatcagtgacatagacaaatctttaaagattacatgaaataaaggaggtgaagtaaaaccaagataacatcacagttaatgctaaagaaattattggtcaaaccaaacagaaaagttcacacaaaatgagaaaaatactttatctgagataaagaaatgagatggtttatgcatttccaaaatggaactgcaaaatgtttgggagaccaggtggctaaagaacacggaatgggagaattgtaaagttaaagcaggtgagaataatcttttcccttaactgacttagacttacaagaaggaagataggatttggtgattttttttggtgcaagttggatcccagataaaccttgggagctcttgggaactcttcgtgggtaccataattagaactgtattgtttctgtgatttccagtaatctactcctgaagagcagaatatggtttgaaattgttcccattcaataagccatcatagatttaaatcttatcatcaca

SEQ ID NO: 139189 - DNA, 2823 bp, Homo sapiens
caaagataacagtggttcaatggttaatatgttggtgtatttctctccagtctttttttctgtgtgtgtttgtgtatgtattatagtctgcattatgtaatatgtactgctttgaaactcgcttttcccactatttactgtcaacactatttattgtgaacattctagttcagtaaattttttataaaacctatttttttatggctgtatagccttcgttacatgaatatagagtaatttgttttgagttaatcatcttagattgtttctgacttttgcaattagagctcatgctataattaacattctggtgcataaatatttgggtgcatttctgattcttttattagaataaattcttagaatttcagcactactaggccacagaaacatgtataaagttgtaaaaattctttgatgcatttccaaattgcactttgagaagtgtttctgtttagtcccaatagcagggtgtgagaagagaatggttggcattatccttgttttatagatgcaagggtttaggtgtagagagattcaagacttgtctaaggtcacatgatgatattacttatcctttggttttctgagccagttctatattctttccactttaccactgttgtagtaaaacttggtgacagatctatagtgatttaactgtgagggaaaacttaatgcaaccatggccttaaaataaatttacctctattattattattacaaactctaatgtgtagaatttgatatatagtgaggactcacttcccaaaggcattcttttatatcttcaatatgttttctgactcacatctaaaatatccactatagaggttatgtttaactgagaaataatagcctaaagtgattttgttgtagctttttggtcaccaaatctggtttacagtattattccttattaagtaatagtctttccagttcagcatcaagacattgaaaagattagttctgtcaggattaaattgctctcaaaccatcataagtaacccttaatgtctacaaaatggactgaaacttttgttgactctcattttttggaagaagatgaaggtaaaaatatagttttaatgtcaagactccagaatgagatgggatataacaattaagggtgatttcctccaatgaaacataatcaaaccaagtgtgggaagtaaaacaaacatctaccccatgtccccaaacaaaaacaaaacaatactgtcaaaaggactaaccacattagtagttttcatttctttcacatagcacttacttaattcttagaataactgggcatcttggccttttttgtctgaggatagcccattcacaacttccaggtcaccagggagccctgtctggactctgctaaaggcctcttgctctttgccttagagaataaatgtgataacattgttttgcccttgattcccaggtagataggacataaattggaattaaaacattcagattctgaaagccaagataacactttatcttatttgaggctgtgctttctttagtatcaccttaccctgggaaccctcctaagtgtttaataggtaccattacttctggggttaggagtgcattgctggaagccttcttattgtatcctgatatgcctttgggaaaaagaaagcccttcaagtgttaacagcgtccgtattctgttttaggccaatgccattgttatttcaaatcatattatcttaatgaaataggagtctatgtaatatgaattttgttgtgtttgacaaaaattaaagttgcataagaattatgatcatgttacagtaattgcctaaaatgtggtgttaaagttcctcacttcagttgttttttgttgattgaacaacctttgggttagatggtaaatctcaatggctttagtaataaagatctaaatagtctaataatatttctaaatgaatcagtttttcagtgtttcaggaaatgacaattttttttaatcaaggcacttatactgaaatcaaatagtgataatagtgtaagttcttattgcttaactgttttcagacagcagggactatattttgaatgagtgcatctgctgaaattagattctcaagaatgttcatgttatggtaggcatcttgaaacagatgattgatgggttccatcaatccacaggtatttattgagcatctacagagtaccatgcactatgttaggtactgtggggctaatatataagatccaatttctactcacaagggagtgtataggctgagtgacaaagaaaccatgaacatactatccctttttgagctgagcctggatggtggggaggctattgataaaagaatatgagagactgggatatccattgtaagtagatataatagtctaagcaaaatcttaaagacaggaaaaatgagcttggtgaatgccaaaaaactatttgagctggaataaaaagattccttaaaggaaatagtatagtggaagagaaagttgaaaaggcaggcgggggatacaatactctcatttccatttgccagctgtgttctagggctgtctgcctagaactaaataaatatgaataaatttaaaaatgtgtccaatttaaagcaacacccaagaaacaaaatctcaaattaatttgtacaacatgtggcattgtaaaataacccttcagggtgtccaatttaaactgcctcctctttcgtctctgtgtatatcatgtgggccacccagtgatgccagttggaaatgagacactaagattagaaaattttgccagagtgattcagatcttgttggatcaagctaaccagctttgtgatttcaaactcacta

SEQ ID NO: 139190 - DNA, 2150 bp, Homo sapiens
acacacacacaaactgtagaaaatatctggtggccatttaaatagaaatcaagccaaaattgtgtgtttttcattttagggggaaagaacaatgatacatctaaacggttatttctaaagagcatatccatggtccagtgtctttcaggagcaaaaataggcaaattcaagcaggacctaagggccatttgctcagcagcacctagaaacaattttagtcagggtccagatttaaagagtttctactcaggtcaagctagagattaggaaaggtggcagatgaaaatcgactcagggtctggcactggttacaaaaggaagcaggtcactaggttgtgtttatagaggaaagagaatggattgcaagattgttatcgctggaatcattgtgggggaggggaagaccctcatttgaagccttggtcctccgactaaaggagcccagagtgctttaaggactcacacataattagccatacattccacaggaagaagtcctgcctctggctacatccctctgccttgaagcaacggaaaaggagggataagggtgggagcaggaggcacggcgcgaagggcccttctggccttctgtgaagacctttctaaagcatctccagattttctagcctgtttcatcctttatattgaaaaccagcagatctttagaagcctcagctagcaacttggggaagagttttttactagtatgtcagtaaacagtggcatgtgaagtttgtgcagttctggtttgttggagctcagtgatctccttgctctttgacaaaaatgttttgtgctgctttagagtttacagcatattgtccctgaccctagagggagggaaaaaaaggacttagttcttcacttcaccctttaagaattcaggtaacagagtgacaaataaaaagcatgttttcaccaaccaaaagtgtggggtgtagttcaccaaggtgaaacatacatgatgatcaacatgaagacaaactgctaagtagttttcattagtatccaattagtaggtgatttggttgataaatgcgtttgctaattcattaacaattaggtaaattaaatttaatgaaaatgatttaaatttgaacataaaacgccacatgtattaatttttactttgtaaattgaaatccatttgctgcctccccccacaccccttcaaattgtgtacagtactcagtcaattagagcacgcagggtggatttttttctcatttaaagtatctctcctctctggaaatcggtcttccagtggaccatgtctgtctgtgtctctagatgagtgtcagcgacaaatggtgcatgtgcacataatactgatgaggattgtgggtacgcagtgagagcaggaaaagccctttgcaataccatgagggattcaggaaggtattttagaatttggaggggtttaaggcttcattccactgctgatattgaattgcagcatgaccaaatgattaacaaacttggctttctggaaatatctcagggcagagaggttctcaaatgattgcaaattggttaattactttaaaaagcatgttacttgctgtaaacaagtaactttgctgggtttttctaaacaactggctatgtttagaagatagcaatatagaccaattaaagatatacagagctggaaagctgatattattattattattatttggtaaatcttagaataggctttgtagtttaggatgatgttttgaagactactgcctcatcttattttaaataacttcatttcagcattatggtcagtgattttaaaagctgaaacacattcctgttgttacaatttgtgttatttttattgtctttctgacttttttcctgatctttggataaatctcattcacaatttcctggagaaacaaccagtcttttaccgtggtggatcacattatatgatttttttccttgttatcaaatagaagattgaatgagcaaagctaaataggtgggcaagacaaacatcaatgtggaatggtctttttaaaaatcagtattcaaataggcaaagtggtggttgtaatctcttcagtgtatgtagctgaaaacaataagatgctgcctctagatctttgatctttactatgaaacggtaggagagaatatgtggcccattgtgt

SEQ ID NO: 139191 - DNA, 1148 bp, Homo sapiens
atctgagttctaatctctgattagattgagactgtctgagcctcaattttctatcaataaaatggggatgataatatctatctcacagagttgattgaatgaagtaatacttcaattagataattgaatgaagattgaataaagtaatcctttccatatgtgtagcatatttcatggtatattgtaagagctcaataaaatttggtgcttttaatgggaatgcaagggaatttaaaggggaaaatggagacaattcctgttcttttttcttctcttcagtacatttcacatttccttgccttgattttttgtctaaaatggattgttaaaattgctaaaactcgaaattttaagtctagactttaagaatattttatattacaataatgaaatactgacataggagctactggtgtgttacaaaacaaaatgcacaaatacaacatttaaacccagcaaatcctgtagcaatcatgaacccatacctacttatggtcatctgatctttctattttttcttcccagtctttgtttggacttttgtaatgataaacacatatctagatcttaatagatttggcctcttcaaatataaggcctttgtggctttttctgtaattctcatcagaatactgtaagtctattaataacactccactctccctctaacttgctgcttttaatctgttgggggcttgaaaactagtttacaaaacttatttggattctattggtaatacaaaagtattcagttatgaatgaggccttgagttggggagagagaggtccccatttttgctgccgagataccttttcctttattatattctgattgttatctacattctggacacttgaggatcatatataagggaaatccaaataatattttaaagattaaatgtgtgaccctgatagcatatgaaaagaatgttcttttactcattaaaaggaactaaccagtaaactacatgtagtaatcctatgacaagtaacccagtgctgcagtgaattgttacattgggttaagcattacgaaaattaccagaaagtagctgaccaatagtgatagataggtgatatggagccaaatgtcttggagagggggatcttttgaaattaggttaaatgacatgtgtttgcaagag

SEQ ID NO: 139192 - DNA, 1479 bp, Homo sapiens
aacaaatgatgtagcaataaatgaaaggagatgtccggaggaaggtagatgtggcctcagagaagcagggctctgttctgtagtatgtgccaatgttgatcagggatatcatgatgtaaatatacacccagctctgtgtcctacaccatatgagactgatgttccttataatgaaccagagccattaaatggtttatgtttcatatacggtacttcatttacagagacaaacaaatgtaagaaatatccatacggcaatgtgtaagtattttaaaagttactttttatccagaagatctcaatctgcaaatacttaacaaggtcaggcatcatgggagatatttaaaaaacatgtgtgtgcctttgagccgtttactaagttgagaccaaacatatacaaatgggaagttgactctcagtaccaggcagtacaggccaactgcttatagacagtaactgctgtggacttcagggatggccagcttcctaggatcttaggtagtccggaaatcttttcaggttcttgagctggcctaagcaggatttaggtgggctcaacataatgccagatctgcagaaacattgtcttttgccctttgggaagttgcagtgtgtgacctgctctcataaactcctccccaaaacaggcttatgcacttagcagtaatagattgaaccatcaactccttaaagcacacctggttgataattagctcaatcacattgtgtttcggtcattacccttggatttcccaaggatgagtttaattcatctcccacattaaagtgagtgcctgcatgaccaaaactcaacagaatagaatttctgtctctattatgtcaatttaatgctgtggtaattttattgcaaaataggtatcggtttacaatttgccacccaaatatctgcacagaaattgttactgtatgctgtaaaaagatctttgatggcaaaaggctcccgtttttcctaaacagtacttcatctgaaggaagacagagggaatgagctgaaactctgatttgaggaatttggggttgataagatctaatattgcttattcagagatgacttactctggttttatagcttataaacgtattgatgatagatacaaccccttgattccaagattttacagagtttattttgtgttttaaccacactccctttgcctctgacctactgctggatgtgaagggataaactggtggtgcatatgctatattaccaaagtgggaagggagagaggcacctttattatatcggattactgccagatgcctagaatgctcaaatctactcactggttgctgtttaaaagggaaaaatacaaatctaaccacttctaggaatggtgccagatgtctgtactaaggcaacccaactccagaaggctataaaaatagcccccaagtagtaggttctgatttcccactgagctgaccaataaatccaacaaccagttaattaaaaat

SEQ ID NO: 139193 - DNA, 1048 bp, Homo sapiens
tggtggtgcgggcctgtagtcccagctactcgggaggctaaggcaggagaatcgcttgaacccgggaggtggaggttgcagtgagccgagaccgtgccactgcactgcagcctggtgtcagagcgagattctgtctcaaaaataaaataaaataaaaaatgaaataataataataataaaatccagagacaagttaaaaagaaatatgtgtatgtgtatatgtatgtgatatgaaatgagcaaagttttcacttccatgaaaaaaggtacttgtgtttgagaatgttttcaaattaaagaaaaagtttaatattaagtaaatatttggtataaaaattcacctaggttaatgtcttttaagcttttttggtctaccctcttgcaaagaaatagtattatttgatttacaattaacttctgaatcaaatgttaacatttcatatgccattaaatacatctattatagaaatggttcttttgatgaatttttatagtggcatgctgtcgtattaaccagaaatacaacattatttttattatatctgcttcagaaacagaagtggttagtttgattcaaacagaaattcctggaaaacccatgtggttttctttatgagcaatttaaggacacgttcttccaaagagagagatggacaatataaaacataatccacttttaaaaataaattctactctgtgaaaaagttccccctgagtggtgctcagtaaaccctttggtatcagtagtttgtcagctctagcacaattggagcttgtgtgggaagccatttcactcagtggtggttgctctgccaccaccaagaagccagagaacatgggctgtaactgaggagaaggataaccatgagagaagtaataagcagaccttagaaaatctttgaaatggtcctaggtaagatctcttatcctggaatcagattccccttcctccttatcattttgttggaggaacatttgagaaagaaatggattttcagttgactaggaaaatgtaaattgataaaaaaaaaaagttaaagaagatgaa

SEQ ID NO: 139194 - DNA, 1060 bp, Homo sapiens
tccaaaatatcttggcaaatatcagtacaagatgtactctttccatggtttcaacttctcttatgaaatggggttcttgattatatggttttccaaccgctcttttttctttaatacaatggttttaagaataagtactgacagttaaacatgtaaactgttggtgcttggtgaggggagacttactttgaaaagagcagatggtaccccgtggggtggagacgatgtggtaaatttgctttctttgctgtgtccataaggtcatgtacaaatggccagaaagcaaatgaaggtacccttgaagccgtttgcacttagatgtcaactttctttcaggaaagactatttttctttatttttgcttttatatagatctaggcctcaatgttgtttgttggtttctcttttttattgctacttatttagtgctgcctcatcaatgacttaggtttctctttgaagtggctgagtaccacctctatagttcagtttcttaaggactccagtgataaactagacttgaaccagtaacctagtcagcatatttttcctaaatgcctcctgccttctcatcaacattttaatctgtgagaggacacatgctagaattactattgacggggatgtattttctcctaagtggctttgttggttttgggaatctttcctctctctctgggtagctaaagactacccatcttcacagctaagtcctacctcctcctctccatttcaaactggcctcagtcccatttctgacctctcagagcactaactgccagcctgataatagttttagcactccatttcattattccttggttctttctggtgttttcctttttacttcccaatttgtttgcggggctctgagggagagaccttgtttcacagaattattcctttattaacatgaggtatatggtccagtgacccactttgttgtcacacagtttgtgaccagaggaagaaatgatgtaagaaacacagggctcccagatttcaaagaaaaaaaatgatgagagagtgaacgggttggcactaagctctctcattacgt

SEQ ID NO: 139195 - DNA, 1298 bp, Homo sapiens
ggctctgtgttcactatgatatccacaagacctagcatgggacaggatgtgtcctcagcaatggtcagagaatgagtgagtgaaatttccaattgtgagggccttacgtaaaaatgataaagaactgtagtgcctggcatctatagtcattaaattaaaaaacgaacaaggaacttagaagaggtcctaaaagtttttgaatggtgctttttgttttttggcctctctgactttcttttgacctttgatagtacttgatactagacttgcatgtctggtttaacaggaatcttaaaaagtcatctctccgaaaggagcatttttttaaaataggagaaagttctggcactagtatcaaggagatgcaaaaacaatgggataccattttttactcgaaaattagcaaaggaatatatatatatatgtaacatatataaatatataaatatctgctatcagtaaggatttagtcaaatggacacatttgtacatttctggtacaacccttttggaacagcaatttggcaatctgtattatcaagggcctaaaaatattcattgtttgatccaagaattttacttctgggaacttctcctaagaaaagtcatcctgaatacaggggggagaaaagctttatgaacggaggtgttttaggaaaacaaaaaattggaaacaatcaaaatgttccatagtagaggagtgaatggttatataaactatgatatgtccatttgatagaatgttataaagctttgtagtttgtagtttcagaagcatataaagctgtgtatatagtatgatataactgtgtgaaaacaaacaaactgaaatctgtacatagataaaattctatgaagtcttataccacaatgtgaacagtagctatttttcagtggtgagatgatcaattatttttgctttttttttcctattttctaaatttttcatttaaaagattttatattgaagacaaattttgtagtgtgccctattgtgtctagaaataaaccttgtatggttttgaatttctagttcaggtcttcaacattcctgtatatttccagtttatatgaagggacttatgaaattgtgaggaaaaaacaaacccaaacatcttcagggcaaaattgattttaattctaaagttaattgaaattaattttaattcactttaatttaaaacatatatgtaaacgtatgtcatgaacacttttaggtcaggggtatgttaaggaatctcacgaataaaagactacaactttttttttttttttgagatggagtctcactctgtcgc

SEQ ID NO: 139196 - DNA, 1844 bp, Homo sapiens
attaccaagtaatgtgcaaaacagacagacatgccccagccctcagtttcacctcatcccccagccatgaggatggagatcagggataaggtgggagtaggggtcaaaaatggaatgggtgtcatggatggggtgaatctcagagaagagatgaaggatggagtagggggtcaggcaccatctggcaagcaaagcacacatctccaggagccatatgtttcccacacttgctcatctttgaaaggccattaatcattttgggcatagtatctgctcattctctgagaattctcttatttcttgaatagtctgtgtcttaaaatttctgattccaaaccttcaagagacaagattctagagtagaggagtatgtttgcgtcatagtatggtctcatatactcagatccaggcttcactgggagtccttgagtcaatgtctgtcagttctgtcattaatattccctgtaaaaccccatgaaaaaataatatgcatctgttatttttaaaatcgtaaaacttcgatattctgatggtttgagggaataggtttattaggctctttagaggtttatcttttttttaataccaaacaaacttaaaaatacatctgtttcctgattatacatatatgaatttttcacttcctcaaggcagtttttcatatgaaattattctttaaaatttacttctgaaatatggagaatctaaaggcaaaaaggaatgcgtaatctaaaacattcatattgaagaaagtagaaagtgagagttccctgtaatttggataagggttgaggaaaaagtatcagacaggtaaatgataaacagctcctagtagtctgtttttatcatggctgcatcatgatggctgaatcagaacaaccatgccagaatgtcaaatataaatatgtcttgattttagcagaacatttgagagtcttctgtaatatccttgtgcatagattgtgaaatttgactgcataactagtaattaggcagattcacagctggttgatcagcggattcaatgtcaacctggaagaaaatgtttttagtgaagggccacaggaactgttttttggctctgcccaaatattcgtttatttaacaaataacagacacttactatatagagggcaccctactaagcactgtgaggaatacacagctgtccagatcagggcccctgccctaaagaagcagattgttgatcataattgatcacaaagacaggctttttgcattgcagatatcgcaaagctgggtggcgtagttcaatatataggatgacagactccagatttaaaatgatctcaacttgtaggaactctaggtcaaaacttacaagacgaaagttaacagtgatagatgtaaagtcttgaatttaggttaagaaaattgcatatgtacaggatatgagagatgtgacttggcagcagtttatgtaaaaagttcttggggatttagttgatcacaagtttaatatgagccaacaatgtggtgtagcttatttttttttttaagcaaaaacaattttaggctgtattagaagcatgtgtgctgctcagaccacatctggagtattatgttcaagtatagtcaccacattttatgaacattgacaaagttgaatgtatccagaagatagtgaccaggatgggtctgaaaatcatgtcatatgagaaatggttgaaagaaagaactggggataattagcttttactttaagcctcggtttagacccttcaagtcttggttaggttcccttgctatgtgctccacagtcctctgaacaagcctcatgccttccccactagaccaaggactttgttagggcagggtagggg

SEQ ID NO: 139197 - DNA, 1198 bp, Homo sapiens
aatcctcaaccattatgagagctaaatctgatagctttcacatactgcgtgctctgggctgcctagggttaagcataattctcaggatttagctgtgctttcttcaatccttaggacttgctcttcccaaacgggaccttcccataggcggggctgccctaggttctgtgtagttcgccttgcacaggcagtaatcccacccctcctgtgtagaagctagaaagcctattgaaatgtgagtgatttagcaatggtatttctatataaaggtgtgactttcaattcacttttttttgtaaagaaaattacttacaaatgatggtagttagtattcataacagctgatgcagaacacttattcacagctgatctggacataccaatgtgttgagacaatgattttgaaaaccacttccacagattattagggaaggcccaaatgcccatcagtgagggtcagctttcatttctgtgtggcatatttgcctaatgctacaaaattttaaacttgatactactcaagaatcagagaattgagaaactgagcattttttgaaggctgtgacaggatcaccaggtgacaacatctcattgagatgttgcacatgccaaaccaaatgctttacttgggctgtttttactccactagcatctctgtgactccttcattttttaaagcggaaatctaccatagctgccatcattttcaatgggaggagtacagaaggtcaaaagttcagttatatactgttcttgtgaagtcaagctacaaggaagtatagccccattgggaaatttcggttatctatttggtatgtcagtttcttctattagtaaggtatctgtgccccaaattgtagtgacactactatttaatcagacttgactaggatggcagcatagagttgaaagagaaactcagattagcctttggtgacttgtcttcttaataaggaaattagaacataccttttaaaaaaaatctgagcgcctggatatttaatcactgtcatgaaaggaagataaaaggctgatgtgttttccaggatgttaacctgtatcgagttgaacaaatgtgtaaattagtcctatatgtactgcatatagacgtgatctgttcacaactagcacagtacctagcatgtatttgaggctcaatgaaaatttgtagaatgttaatttgttactttagcaaaac

SEQ ID NO: 139198 - DNA, 1157 bp, Homo sapiens
tgctcaagaccacacagattggatggggcagagtcaggatttcaacttgggtctgtttatttccaaagactgtgtgagataaaatataatggggtcaagagacaggaggcttattttttcttaaccagttgcaaaccgagcagtctaagcagtactgggacgagaaagtacaaattgagagccagggtataggtatagggcatttatgctggtgaaacctgggaggtccttgggtgccagaggttagcccaggggctctgaatccctggggctgataatatctagcctcatagctctattgtgaggattaaatgagacaattcatgtaaagggcacatgatacaggcttgctcaataaatagtagctagtattattatttctcttatttaggaccttgcttgttatagggattagagactcccagaagcctgaggcaagacatgtttaccctagtgaatcctgtcacatcttaatagtcctcaaacattcctcaccattgaaatgccttttatttgaacctttcaaataaacaagccttaatcagctttgtgggccctaccagcttttttagaaaacctctctgcttttggggtggggcggtatttatttactcactgaaaatagggactttgtgtaatacaagggaagcaggaggtgattggtttggagttaataggcaagctttttttttttttctctttaacttgaggaggcttgattgggttatgctccctaaagactcttggagagtctgggaattttgagaacaaaagctctgcagggaggccaccaaagagagcaggctctccaccaatctttgtatgttcttaaatttttcattctatttctttcctctcttcagtccctagaatagagtggctttatcttgaagccatggagatttacgaaacaaccaaggttggcctccctttgttgagcttatgaaagccatatttagattgaggaggaatgtgtttttcccttgggaggcccctctatacctgcagccatcagaaattccatattaaaatcccacgtttaagtctttacagctaaagtctgttcttgcatgtctggaccaggtccagctgtcagactgagatattattgactttttcttctcaagtgagtggtttacatctgttggctccatttc

SEQ ID NO: 139199 - DNA, 2721 bp, Homo sapiens
ggtgggaccacaggggcaagccacctatgcttggctaatattttttttaaattttcacagagatgggatctccctgtgttacccaggctgatctcgaactccttggctcaggcaatcctcccaccttaacctcccaaagtgctgggattacaggtgtgaaccaccatgtctggccaacccagacttagccctctcttcctttacccttttaccatttttatatgtaattccttaacgtggtagctatgtgggatattatctttttaaagaatatatcttactgacatgtaacaggagattctctttgtcttttacattatttctggtaatattatgaaattcacagacaatgtttttatatttacatatacacactttaatgtcaccgaagggaaggggttgtgaaaacaagtgaaagttgaagtttagggaatcactacctactggagttggagagcaccaacttggcatgacttggatttactaaatgtaccattgcctagcactgtactcctcacaggtagtaagtaccttctcaataaacaggacgaacagctgaaatctgcagtggtgcaatggaggcaaaagggtctagaatgttcttggtggtgggaatgccatttctgctcctagttcactgtgttgggtctcatttgaattcagggaccttgcttagcacctgtgcttctggaggagagtatcctagctgggttgctggcctcttctgcagcagggactgctctgtcagaaaatgagctgccactgcagtggaggtggttctttccgcttctgtcgcccttcacagtctcagctcctctcgtatttataagactgctttaatagtcttgtcttgtaattacatctggagacaggagacagcatcttttgatagttcaagtcctaacgcatttaaattgccctcctaatgctataaaagagtcaaattatatattctggtttgtactagatagcaataaatgtcaaggtgccatccactctggtatttaactccttgctgccatctgttttggtgctcttcacatggaccatacactagtgttttcctatctcctggcacgaaaggatcaagttgggagataaatctcactattcaaaatatattaaaaggcagaggcagtttgtaaacattgctttggaaagctaggcgtagcaataaagtcaaggacaggaacctgatttagtaaaggaaacatttcactagattgtcatccactttatttttaaagctgcaataagatgtaacgataaaaaggccaatgatgcatttcagccaagtgatatgaactcttgctaaaccaattaaactgtcagtatactatggtttcagtttctataacatactaggtcaccttagaatacttagtcacgtatgactttttaccactgatgcaaaatcaatttggcaatttataatcttacatttcattatgaaagtatattattctacaagaaagctgctggaaaaatgagatatttctgaagcccattcactcctctcctgcttaagtagtcataaaagaataaaaccaatcatgttatctgatgttttgagaattctaggtagttttttatttatatgatttttttaaaaagatatacgaagtatacagtttctaaccctggatacaattttgaatgttggataaaattgtggacattaaaaagtaaaaattttgattaaagagctcactttttcacctacgtttttcaattttgtagtgtgtggacagaaagaaaactttgcttaagtatgccagagggtgggcttttttagtgtcctatatttgaggttttgagctccagctctcctcaaagggatagagcagctggttattcatatttaataccatcacatttttcaattttggtgtttggaaattctgagttatagaatgatgaaccagcagtatttgagaggtggtggggaaacagaaaaaggaagagttggagacttttattgttattactgtaattttttaaaaaaatatcttccctttttctctctaggacaaatgtaacactgctttttgaaaaaccaatgacagtcataaaacacacatgacagatccttagttttaggtgctcattagtacagtaggggacagatctgttcttatactctcatatagcaaacaagaacataattaacattgactgtatagccctttacttctgctatgagctcagtgaggattttctttaactgcattaacactggaccatttaaacttgaggttttcatctttttcagtttaagtcatggttacagagttggcaggggtatctactatattaatttagattcagttgggatcaagtatgtctaatttacatatgatacaaggactgtgggccactcaggcatttgcctgcctccattgtttcaggtaattccactgtcattggtgtatctcctatttgtatattctttctcagactccagtctgaacacatggaacacattgaacaaaaagagaaacacagagcaggaattgactaattgaaatgagactcatttcacactttctttcttgctgagaaaggtattagaacgactttctgtgtgttaagtatggagataggcatttgcacctgcactgtctcatttaaactcacaacaactctttagcgtaggtaatattattctctactttagagatgaggactgaggctcagggagattaaggaatttgccatgga

SEQ ID NO: 139200 - DNA, 1166 bp, Homo sapiens
gtaggaccagtctttcttcctcctttccctctagccttctcttaaaaaggaagaagagaaagtcattcttcttgagctacttgctgccaagtgtcattctcccagggaatccaggctgtttcagccagacttcccttttcctggctttaaggttaccaagccaagtggaagtatacaaggcccaaaggtaaagttcctgttccagatggggcagagtagccggcgactgctagagggcagcagagggccaggagcaggtctagaactgcttaatggccagatggcaaccagactactgccagagcaaaagacgtcagaggtccctcattgttgcggggagaaagaagtaggatggtccctaaccaggagagacaggcacatccaggaaatgttaacataacatggcggagacacatcacagagcaggcaactgggttggtatacagtgcaacatatcagggtaggcagggccaacgttttagtaaaagaagaaagaaagcatatttgccataaagatcaagtcagaaccagtgctacggtcaaagttcaagtcaaggttgaaaaaatcaaggctcaaaagctagaattggactgattcagctcagttatttattgagtatctttcaagaaaggcacaataatggaatagttaagatcatagactttggaatcacataggaactggggtttgaatcactgctctgccatctattagctaaatgactttttgtcaagttactcagcctgtctgcaccactttgaaatcatatgtacagatgctaaagaaatgtttgctgagcaaatcacttttatccagaggtgtttctagaaggattggggttactgattgtagctccccacctcaaagttctattccatttggtttagtacttgtttttgtcccttgtttaagatgagtggagtggctaccggtgctgccttggttcccagccagcaaggacctgattggtagtggggcatgaatagagctaagaggggcccggagaccagaggagagaaacaataccaaagtttctgggaagaattctgagatcagttaattcatgtgcaaatcaggaagacagaatattctgacttattctaaaatggtattttctctatattttcataaccttgtaatagaaatagctaagctaaaagaaaat

SEQ ID NO: 139201 - DNA, 4243 bp, Homo sapiens
tcttttctcttacagtgccaaagggaatattttaattcctgtgtttcatgtactggagcggaaccccttagggtttccagggacaacaggccagaattgcactctctgctgcctcccaatgtgcagaaagagccagtcctttccgtagttcactagggaagtgagtgtaattggtggttccagaggagtgaccctgagcagtctgcctaggaaattgtgttctccctttcagcgttccagaggtcaaggaacaccaagctccaggcccagtctggttaagctacctcaaacaaaagacctgaatcctgctgtcatattgcaggcttgaatttgccgatttgccggggcggtggcaggggggcggaggggggacggtatttttggttagatgcctcaaacactttaatttttctgttactgtcagccagctatttagtgagcacttactgtgtgtcaggcactgctgggtagtttcagacatgcacatggtagtctattcagctaaattcctcaaacattgacgtcagtctgtctatggacatgatctccgtgttatttttatttctcaattaagggctcatggaagaaatgctttgctttagattgtgtttcaattatatttcacaaataatccacatttggagtgtggtttagttcattgttttgtttttgtccctatccatataaatcactctatagaaaaacatcagattctgttttcacagaagtcagggaaataagttgtttacacatcaccatttgactcccttcacccctgtcctcattacaaacatctcagccacccaatgaagtttatttaaactcccaagccatccatgcaaataagacccctacagctacggagtttggaggaagaaaggactaggattgtctgccacttccttattctctctactgggttcagaacatttcttttcatgagttaatttactacccagaggcttggctttagttgtgtgtcctttttcagttttgtaaattagggaggtggttccatagaatcacagcatatcagagttgtcagggagctttagaaacaccatcaaatgcaaccctcatacctctgtgtgactcctctgtacaacatattttgggtgagtggtcatttggttttggagtgaaaacctcttctgatcaagaactccctcccctaagaggcagccgtttaatttttggttagctttagttgctagttcttatgtttgttggcccacaatccatctccatgtaactcttttaccataccagttgctttcatgtggcttctactcaagtaggtttctacttggttgttatccttctaaattgtggtactcggaattgcccagtgtgatgcacagggtagcaattacctcctattatctacatagtattacttttattgaggcaaccaatttaacagccactcatggttgagttagcaagtgttgtatttataatcaagcaaaattctccaaacttttatcactggccttcatttcacctttggggatttggtcctgtattgatatgacatcttactaaatttgagcccagattttagggtttcaaaattagttaacggttcttccagctttagtaatttgtaaatatgatcagtgcatcatttatgccatcacaccagtcattgattaaaaatattgagcagagaagataccttaaaatcctgattagagacttccttttcagttgacattaatctattaactagcacctttagtactgccattaaatcagtgagggaaccagccagtggtgttctttgcagtccagagcagtctctcttggacattactcttcactttgtccaaggccctcttgaaatccagaatcagtatatccactggatttctctggttttcagcccagtacccctatcataaaagggaatgaggttactctgccatgacttgttcttataaaactgtgccagtttcttttgaatgcctcttcctttttgaaatgctcacacatcttctgcttgatgacatgttctaaaatcctgttggggattgatgttagactggtgtgattattatttgtgacagccaccttcttttcctttgagacagggtctcactctgtcgccaggctggagtgcagtggtgtgatcttggctcattgcaacctctgcctcctaggctcaaatgatgacaggcacattcttttcctctttaaggaatatggaaactagatgggctttgttttcactcaccttacccacctcttctacacctctgtttccacgaatacttttctctttgtcacctttcccagaaatggactgactctctccttcccattcattcagaacactgccctcagttttcctaggtgagagctacttcgtgtggtaataggtcctaatgggctaacatgtttttgacaatgagtttctttttcctattcactttttgagcagggcctaagtcccaatgtgtgattagaatggtggtaatttgggacaccatggcaggttattaatgtagtgtggatggtgaaaacctttctctcaaataggtggctgcccatttcgacttcatatatggctttctgccaattgtgttgggggcgatttcaagtcagattgattggctaattgcttgtggtcatctggctttttagctgcttgtatagcatccgtggaggtaattagcacttccagaattgggggtgaattggagttattcatggtcatggcttttggagtgggagcaggggctgcactcgcttctagttatgagtgaatcatttttactttaaaatgattactgaggattgatgagtttctttaacaattaaaaaaatccattatggaggagtttgatatacaattgccttctagagccatttaaagtggccagttgggttctatatattgtgcgataaactcattggtaggaaatagcttcaaaagtgttgagcattttctaaaagcgactggaatttcaattgcagccctgtaccagcacacatagtggaatatttttcagccaagtgttaatgttaaagaatatataatacatttttcatttaaaaatttcttcatatgtaaatgtcatgtaaaagccactggtatctgacagtgattcccaaatttagaatcatcagaatgtcaaggtgatttctcccttttaaaaacaatgttcctgggcgatttataggacggagaacaaccaagcagaacatctcaggactgccatttcctcacgtacctggcatttgtcagtgtcaatcagtactgaaattcaacctgtggcagtaaagcaaagccgagagtcatctgcttattttgactgttcctttttcataattaaatgggagctgatgttatcatctttggaagatccagcttgagggtgacttgcttttgcaatgcaaataaacagtaggcctgggccactgccgagcctagggctgagaagccttggcccaaccagctgttgtaatccagttgttcccatgctgttcagggtggtcctccaatcctttgacctgctggctgggttgtacagccctcatcttagaggttcttccagttttccctctttctgtgttagattctcagccttgactaatggctggaatttatggaaggctagaagggaaaggcaataatttctctcctctgtcttcccagtgatcaggaagacctaccgtctatttcaggatgggggtggggtggggatttagggaggacatgttttagattattctctcttgaattcttgctttagggcttctcataaaggagggagcagtgtctgagacctaccatgtcctatctctctgatcagagcttccagcctgcctcctccacttcctgtgtttagcaagtttgatttttactttcacttgcttttctcttctcagcctgtctcctctccctgactaaatgggtccgattttgtttcctaaaaggagattaaattgctctttgctggaaaagagaaacaaacagtcgcttgggatgctgtgtgtgtgtgtgtgtgtgtacacgcgtgtatgtgttggtaaagggtgctcagatggggaatgtaaggcttcttgttggaagtctgttttcaatcctaatggctcttttcatcctaaaactgtttgggttcaaatcctggctctgcctctatgtgaccttgggcaagagccttatcctcttagaccttcatgttccccgtctttaaaatggggctaatagaagactctacctcacatagctgtagtc

SEQ ID NO: 139202 - DNA, 1051 bp, Homo sapiens
tttctacctggcttgagggaagaactattattttacatgttgcctcccatgtcctttctcaaacatagttattttgatctcacctatgttgcttttaagagggactagtttggggcctgcagaattagaagctttacccttatggttttcaactgagtataataaacatcttttaaagaaaccaaacaacaatagcaaagctatagcccagtggaggcattaagggagttgcaccatttagaaatccagctgtgtttgttctgattataatcaggctactgtctaccatttagttctcttgggaggtgatacagttaaaatcccagcatctgtagaaatagcaagtttatccactcagttatatacactgagctttctgttttaataaagagaggtggggtacaatgatcagattaaggagtatgggcaatttttaccttgagcagaaggaagcagtcctccagtgtgttttagaatcctattcattgctgacactgggagaagactgctgacaatatgggtaagctcaccttgatcttttggaggggagcctcctccaaccatttagaacagtacagtgggaggaaaacaaaacaaaacaaaaaaaacataccacagagtaggaggtggaatatagagtttatattcatggctctgctatgaagccaatagtgtaacaccaggcatgtcttttcctgatgctgagccttgtgggctagctgtcatttagggcttagtccttagtccttccagggctattgtaattgttgttaataataatcaggaataatagtgagagtttccatttattgtctactatgtgccactatgctagagggttttaatacatttatttaatccctgcagtaatcctgttaaataggtagcattgtcttcatttgatgtatgagggaaatggaagctcagagagggtaagcaacttgttcatgtcctatcttctgccccctccttcctgggtccttctttccccatagccagtggtcaccaagtcctgttggttatcactgccctggtttcagccctcagctct

SEQ ID NO: 139203 - DNA, 2216 bp, Homo sapiens
agtcatgtttaacttgcttgaaggacttgagcaagcccattaattgaggctgctaattacaatgagctttgcctattaaagcaaacctgatagaacctctacttggaaacactttattagcagtgagtttaagttactctaggtatggaaaaataataaaaggcagtgtagtgtttaagagaacggattctggaataaattgacttgggtttgaatcttgttacctgggggagtctaccaaacctctctaactcccaatttcttcatctctaaaacaataataggacctaaccttacatggtttttgtgaggaataaatgatatgatgcatataaaacttaatttagggtggtgcctagtatatagtgagtgctcaatgaatgttagcttgtgtttgttaattttggaaagtagttataaatcacacttcaccatccttccccttcatcaatttggcttagtgaagatccaggaaaacatcctatttgttgagctagttgttcctgaatttgaatgagcagccatctggggacagtaacttcataaaatggcctacctgttctatgggccaaatatgcacatggaaagagatgatcattggatctataagtcttttcagtttcccaggagggaaattcgaattgaacatgttttatgttataagcttagttgaccatgagttgatattgtgaagttattatggagcctgaaaaatatcaagagtttatatgtctgaatattttattacaacatttctaatattgttcctcttctgctgtcctgctgataaggacactttactacataaataataggtgttcgttttagaagagaagttactaagttctgataaatataaaatagaacataaaaatcacccagaatcctaacatccagagatcactgtggtgagcataggctttctcatttttttcctgcatatttcacacgtgtaggtttttttttttacaaaaataaaattgtactgtacacattcaaagcaatgctggtgataaaccaaagagtgtgcatgctctctacagttatgttcagatgtggtttaaaataggggtattaatttgtaatcacaagatggacttgaagttgaaaagctgcatacaattttatatctcagagtctgcctcaaatctatttctattgacaccaatagaaatttagcccagagaatatagcttcaattatctttgtaggtttattataattaagaatggatgcgtatgtgtgtgtctttgtgtgtgcacatgtgctgcgtgtgtcaggtggagacttttccctgttgtggagtctggtgacaagaacattagactaggagtaacaggacatggattgtggccccgatgccatcatgactcactggatgaccttgggcaatcaatttcatttctctgagctttagttttcccatatataagatgtagggttagaccagataatttctactgccccttgcagctcaaagagtctgagtgttaaaaaaaaaaaatcaaacctgtctgtctgtctgtctgcctggaagaacccgaggctctgtggatatcttcctaaggagaggaggggtgatgaatttaaacagtttctttggcgccagatagaccaaaggctgtaatttttagcctatcaggcgtttgacttttgcaagtgctaaattctccattaggaataaatgtggaagctccaggttatttattgttatttacactttccattcataactgtcagtgtcagaggctctgtcaacataactgcgtcaatcaggttagctttaatcagtttagtggtggctaagtcacaaatatatcaaatagccaatcaaaatgcaggagccctctaaagcctgactgaattatttattttgttatgatgaaaatgtctgggctttattgggttttctttgaagaacttgattcagcttgaagtctagaagataaaagatcagtgattgtctctcagatttttattctgccttccttcaaggcttttcatttttcacaagccgttgttagcacttctaagtcaaggtgagagagctgtgatatgttttatcctaggggtttaggcacgtgtggaaaacttttacctttgatttcttgtcctgtttatgtcatgtggaaggtgtgtgaccttgagctaaccacttaacctgtctgagcctcattttcttcatctatataatggggataattctaatcttacct

SEQ ID NO: 139204 - DNA, 2024 bp, Homo sapiens
cttaccgggattacttaagtgaaggagaaataaagttaactaatcttactaaaagtgtactatgtgctagacttgagtaatcttcataatggtaataacaccattaggtattattatccccattttacagatgtggaaactgggattaagagctattaaccaatttgtccaaggccatgtaaccagcaagtggcagcattaagttgctaacttcaaagtcattgcccttttcattgagccacacggtctcccttggagctagaagataaaaataagctttaaaacttattgaaatgatcatagatggttttgaaaaatagaaagtgctgttaggaatctgtacagtaatggagaaataaacaaaacaccccaagaatgaccccaaacttttatttggcagaaggcttcaaattccattgatatgaaacaattctctgtagggacatactagggtgagttaattgtaccctgagtattctatggcagggtggcagcctttcctattgcctcataaagaatcgcacacacactcttcagagttcattttagtacttttcagcctgacatctaaaggggctgctaccctgacaaacacaatctggccagatgttattattttgcactacatttaatttcttcctgccaaagatttaggcttcttttccctgataaagatcaggggaaattgtctggtatttacaaaatcccatccaggcatatctgttacaatgttcacttagcaaagtttattagattattagggctttaaacccttgggctctttcattattgaaattaaaaaaagaaaaacccaaacatcttcaacaaatttaagtggtataattagaccctggacttgtcttacaggcattttagaattatgaaaatgatttaaatagtatttgcttcctgagaaacttgctgcattcgacagggatgaaaggaaagcagttaagctcctttggtctcctgagttaatggggaaagtgatatctggaactgaaataaatttgctatagttgtatggtgaaattactcccataagtagttagccataccacacagggcctctctttcttggcctagttaaaatgtagccactgtagtgttagaggaacatgtgggtctgtcatttccttgctcatgaagtcttcttagagtaaacactgaactagactcctgaagctctaatttttgcttatatacactatactagacatgtaaagaagacagtaatagaaatattttcaaggtataatcaactatgatttatatacactgcagttttccttaaaggatttcaatgtgacttgcatgcagtaattgtattttcaatcatctccagttgaaagttggtggcacgattgttattttctctactgtctgaatgtagacatggaagaatttagacagtgtcttgacttcatcaacataaggagccagtagctggtctggaacttgagctagtaggatgtacatgagagaggcaatctagtagaaagcaatgtaattatgcttatttgttttggggagtgaggtggggtagctactaattcaggcacccaaatcctgtaacattaaactttgcttaagaaagaaggagaattatttaagaaaattgaatggaagtttttgctacatgtgccaacttgagtattttcttctattgtacatttacttggtgccagatgaggttttcaacaaattgtgaaagcccagatctttagagactatgttagaaatgtctcacaattaagcaggaccatagttggactttttcttcttattttgaaggcggtcagaagtcttttatgtgaaaactgtaacagtgcaaacatatgtttgtacattaactatacaggcaataaatgctgaaatggcagaagtgaactcaaggcagaaggtaaatattttgtaaaaattaatgatctagagtgaactctcattaacttgggctctgttaatttgaatattgtgatagtttgacttgggctgaagtttactttcatcccatttatgaagaa

SEQ ID NO: 139205 - DNA, 1316 bp, Homo sapiens
actatactgctttttcatatagccatctttccatgtcaataatgtacttctgtaacacaatataaatatagtatctaggggctaccctttacttactactgtggatatttcacatgttattaatccaaccctctctattgttggaaatgaaggttgctttcagtaagccacagtgaactaaataatgtccgtgtaattaaatatttatgcacatccttaatgatttcctcaggataaattcctggaagtggaattgctgggtcagagactatgcagtttttaagatttctcacatttattgcctatttgatttccataaagtttgtatgtgctttcactttacttctttttaaatactttaacttttaatttttgtgggtacatagtaggtgtatatatttatggggtatattagatgttttgatacaggcatacaatgtgaaataagcacaccatggagattagcaatgtaagaatgtccattttcctgtctgccccttgccattttatcataatcccagcgtgggtgaaaaaaatagtactctttggttgccagtgagatttgttgatcatttgtaccttttattttgtgatttttctcactaatattctttcatcatttggaaaaatttaagtataacttgtcccttactagttgtccttttcttattgatttgtaacaagcagctctttgtatattcagaatgctagcccattttgtataagttgctttaactgatttgttaattcaagttttctttttttgtgggggtttaaacatactttcagtcaaatgtgtcaatatcttaatttggtttccaatatattctttgattctttactaattgatattggccttagcatgaatcaaagatgtgttctatttcctgttctgacaccagctgtgtggaaataggtaggtaattcaaagtctctaagtttgttttcttatatgcaagatggtaacacctgacctgccaacctgctggagctcttgaggatcaaaagaggtaatatatatgaaaatgttttgaaagtttaagtgactagtgtagttgttattcacttgtcccttggcacttatcagtctgtactatatcagaattgcctttcttcctctggatctgaaacctttctggccttttaataggaagtaattttggtctagaaatgcactggagcctgtgccctggtagctggaaaggtgctctagagagtggtgaaatgtagcctgccaccaggctctgcctggagtgtggattctggacatccttcccagttggggaaatgggccctggaactattctttgatgtag

SEQ ID NO: 139206 - DNA, 2321 bp, Homo sapiens
ctggaggagactggctgtatgaaatctccagatagacatgctgttgatcaaagagaagaacacatgagggagttgggtaaatcagtgcacatctttttctcaattaaactcaaactcaaattattattattattatttgagacagattctcgctctgttgcccaggctggagtgcagtggcactatctcagctcgctgcaacctccgcctcccgggctcaagggatcctcccacctcagcctcctgaatagctgggactacaggaatgtgccaccacacagggctaatttttgcattttttgtagagatggagtttcgccatgttgccctggctggtctcaaactcctgggctcaagctatctgcccgcctcggcctcccaaagtgttaaaattacaggtgtgagccaccatgcctggccaaattcaaattattaattgcctattagatactagcctttctggactccttgtctatacctgtagtctctcacttagacttccctcttggaaggggcaaacacctaggaggcagcaaagggcatagtgtgatggctatgtggtctggcttcaggcagactggtgtctaagtcccaattttgccctttcctctctttgtgaccaagggcaggccacttctctctgagccattcattaaacaaaattaaatcagatgagtgctgtgaagaactcagctctatgctggcccataggaataaaatgcatggtagccattgtttttattattccctcttgtgcatttataagcatatatatgtatgaaatataatatctttgctttgcagtaatgaatgtcacatatctggcacatatacatttttaaataattttttatgttttaatataattaatgtcaaaatgcactaaatacccactcataatcctctcattcagagataaccacttgtaacatttttgtgtgttttcttcctttccctttctgtgtgtatgtgtatatttaaaaccgtacaatatacagtttctaaatggtcccgtagtggtctgaatgagttaaagtagcctctagatctactcagcaaagggagactgattccactggattacattaagaaaagaaggagaacaaaaatgttgaaaggaaattggaatgcttatgacactcctctcctttggtcagagttctttagcatatagttctgaacccaattaactgaaatgtcattattggattgcatttcttccctctcctgggaacctgtgcttttcctttctagcactcatcaggttgcagtggttacaggagtatgtatggttatttgattaacatgggtatcctttactaaagaatgagctttctgtggatagggcttgtgtctattctaccatatccctctgtccccaggtgagacagtaaactttcagtaaatgtttgaatgaacacacacacatatatatatatatacatacactctcacacaaaattagaataagtagtattgatagaaatagatttctaactgttccccttcccctgcaacagtatgaccaaacagaaaagaaaagatagatcctgttgcctgcagcatttacttctaggttttaaaagctgcttagatataagatcttaaaagtctggataatggggttttgctcgcccattgagatggaacatctgtttctctaagcctctgcctcagcttctggccccataactctgaggctggctggttgtcttttcttccagcatgacctaggctcttcccagaacactgtgaacaagattcagtgccacagatttgcaccttgtgaacaagaaccatgagaatggtgacacctgtcagcttgtccaaatacattcttgtgtgtcctaccaccctttcacaaggacctgaagggaagagaagctcccttttcttgaaagccttgtagcaggcagacatacttgtatttatttggaccttgccagcttcccttcaaaaaggtggtattaatcccataaggagactaaaactaggagagtttggtaatgtaggcaagttaacccaatgctaaataattgagttgctagacccaagactgctgaatttaaattgtgctattctcttataatgctatgtgttctctctcaatattgttgctagtgcatcaaatttggagactattcacataaccttacctttccttagagttttatatttgatattttagtggaaggcacaatgtcagaatagatagtcttttaagtcaaatagtcctgtattcaaatactcttgttactcactagttacgtaacccccttttacaaaatgagggtaataattacaaccttacagcactgctg

SEQ ID NO: 139207 - DNA, 1991 bp, Homo sapiens
ttctttccccctgactagcctgacagttctgcccgcactccagctctgtgcaggctgagccccattgcatccccaactctaactgtccgccagtctgtcacaacccctttcttggttaaaaataatgtatgggagagaataattacactgatgtctaatcaaaacttaattcatttgccgaggctaaatacaatagcattaaactgaataggataattttaggaactcaaaccatggccatgagtgaagttatatatcctcaaaaatgtaaattattaatcaaaccgctcatctgtacagcaaagctctagtaatcccattataaaagggtgaatttctcattagagcccagaagatgctggcattaattagtggactttcatggcaccaactcaaaggcatattttggttacaaagtttttaaaaatgcaattctttaattattagggcaattggaaaaccaactggaaactgagtgtttaaagccatttcagttttaaagtaaaacttttggattcaatcgggtctcaaaattctgtggctttagtagagccagaggctgggggagttataaacctttcctgggccctttattgatttagaagtcagtcattaggctgaaaactgtttaatgaaaagagcttagaaaaacgactcaatatgcagccagagaccattctggggccaaccatgaggtgaggagattatgcagatgaactcttttaccccaggccatcgcccttgattgaacaaggtcctgaactcatgcccttgatttaacagggctctgaactcacctcctcttgctgtcatcatcactgcccacctttctcactagtgggctcaacaaagcacattaaaggacattgtccctgccctctagaagcttccaggaaaaacaccacttttgcctagagtgcttactctccacctccccaccagcccccaaactggaatttgtttactttctgaaaacatatgttcctcctcttctttctgtctcactgagttgcagtacctgatattggagtaatgaagcatatgtttgagagatttgaattctcttgtcagtagagtggaggtagaaacaatttccctctaagctggaaatggtaacatagaaattaaaagccccttcccttctattgactgtgagatacttccagggactgaggcacctgtattgctccttttccttcattgcacttttcagtcaccaggtctcatttcttcctgcatccttcttcacatcattttcctacattccaactgagaccccatcggtctcagttgtctcatttatcatatgcagatggcttttgattttagttcctctctgatttcagttccaggctccatcagctaacatctagactaccagcaaatgcacccctgggtttcatgcctttagcctcccttgcttcccagttcagcaatggagtgtaatgattaagagtgcaggctctagggggcattctgacagggtgtgaatgagtctgggtggggtaggcaggctggtatggagagaagaaagttgagggcttgggtgaggattagagacctcctttctgaaagtgtactgtattggagagagatgaataaaaaatttcctcttctcaagtgttttacttatctcatttaaacctcataacaaccctaggaggtgggtactttcattagcctcattttatcactgacaaaatggaggcttaaagagattaggtgacttgtttaaagtagcacccaatagatggcagagacaagaattgaacgcaggaagtacagctccatagcctgtgcccttaaaacagtgctatatgtgtgatacagcctctgtgtatttcatctcatggtcataagcagtctcctcaattctaactttcctccttgcaagggaactctattgtatttaattaaaaaagcattggctgagcaactggatagcatgtctaaaggcaggtactgtgggggattcaaagagaaaaactacc

SEQ ID NO: 139208 - DNA, 1050 bp, Homo sapiens
gagcctactactgttccatgtttatgcgtagtcttggcacacttgattttctggctttctagggggggatccaagaactcactaaatgtggcacttggggacatttaatagaggactatactcctacaggccacagtggctcctgtattacgttaggtccaagtgatgttcacaatgtggttacaagtaaataaggaaagtccaacttacattcactgtccttttcttaatatttccattttaaatggctaaaatgaatttcctcagtgcttaagatcagcgaaagaaacactggacttggagtcagaaaatccaagttcaaattctagatctgcatttatgagctttatattttggggcagttatttagactccagtagcctcagttttcttatctgcaaaatgggcataaaaattgcagtcctgcttacttttgtaaagtagaaataatgaatgtgaaagtatcttgaaaactgtaaaacaccatatgcatgcattatctagacagctcatttatgtggaccactttaccccaggtggtgccaaataaatgatgcattatcattacagacattaacctcgacaaggctggagttcatgatgtatttcaacaacttttgccacttattgatgatatatatgcaaacagctccagtgtacagacaaaagagtacttaggcaaaagactctttgggaaaggggtttattttatgcactcttggatgtgaggctgtactgtttgaagtgtcaatactgccaggagcaatccttttttcagcttcctgaagcttctcttctggctagtatctggtgtatttcatatatgaataagcagctagatcaggagaggtttgtcggttcaggccatattttaattgcattttttggtccacactattatggcagagaggagaaaaaggttggtataagtctagagatcttcagttgatcctcactcagtattggcaagcttgctttcttctacctgctttctgtggagatgaaaaagacatctctgaatgggggggagggcagcgtttctgtgcttct

SEQ ID NO: 139209 - DNA, 3909 bp, Homo sapiens
agtattgggttggccagacatacatttcatttggaaatcataactggaattttgaaaattgtttcttggttgtcttctcattcatacattataatcaggaaaaataaattataggagtgaagattgatcttttaaaagacaaactaaatatcggtgttcagtgatgtgtttttggtgctataaattagtttatgcagaatttatgagtcaaacctaggcaattaattctgatggttattcaaaaagagtcagccataaggacaattgggagaaagcagggattagttaagatgaaacgtaattttgaataatcaaaattttactgtatctcaaaagaaatgcattgtttgccctgtttgccatgtgtgagtgtgtgtgtagggggtgggggtggtgtgggtgtgggtgtgtgagagagagatcctgcttactgaaacatgaaaaccttgtttgtttcaggatcagatttgcaagtatgtctccctaagggcccaacatgctgctcaagaaagatggaagaaaaataccaactaacagcacgattgaacatggaacagctgcttcagtctgcaagtatggagctcaagttcttaattattcagaatgctgcggttttccaaggtgagttctggggattattttagatgtgctgcttagtggcatcattatttgggcactgggctttcaaatactaagtataatttataaattaccattccagcattaatgcttgctattaaaaacctcccagtgagaaattctggtttaaaaaaacacattttcagagaagcttcatttcaatctttggaaaggtgagtattgtcaaaaaatcattgtccaaggacattctatttacctgtatataaaggttataaatctctacagaaagaataaataatattttctctcagcttgattcaaaaacaaaaaagttcccttaaatactgagcccagttttctccaggaatgagttagatgcttgtgggatacatgtggactccttctgaccactaggaccatttccatttaagaggcagacactggcttgttggcccaggattttcccattggtgtgagtggtgacctctcctctctttgtgactctcacttcttaccatgcctgtgaatgattgcaagagaagctgttgtggcattgccagaacgggtaggaaatgacacttctccttgctaacttagtaggactatcatagcaggatggggagtacctccttcaattctaacacccagctaggaagatgatgatgatgatggaggtggtggtggtggtgatgatagcagacacttatatggcaccatgtgctaggtgctcttttaagtggtttacatgtattaattcatttaatcctcacaatataattatgagtagatgttagtatccttattttgtcgatggaaatctaaggcacagaatgattaagtaacttgctcaaggccacaaaattaataaataaatggtgaaggcaggatttgaacccagatggcatggctcttagagtctattcttttaactatccccataggctgcctcctgtaactgggaaaattaattatgggtattcacaattaattagtaattaattaattatcagtctttcttctatccttcctcaagcagagggaatcagccacctttttcttgcctcaccaagagaggatcgaggtcagatagaaaaataacacttctgactgcttgacattgcaaagcttgagatttatggcactgttacaagaattaacctctgaattgtaaggtgtgttgattatagcttattttgtgtattataatgaaatctttagaattagctaagaaaattgttcagattagttaataaagcctacattcacaacagtttcttgggtcaaagcctcagggggtattaggttgattatatgaagtataatatataagcttgaagtatttgttaaactatttatgcagtcagactcttgtgaagagtttgttgagactaacaatttggtgatagaatgaataatttagacagattttaaaaatacatgtagcattcatgaacttcttagattggttttggagttgatctgttggatgaaagtggggtgagaagaaatgatgtgacatgagaattgggttgaagcagagagctgaatcttactctttggggcatcaaggtccctttttagaacagagtattagtgatttgtttaattcccagaatatccaagctcacagatgttaccttacaatccttgtctggttggaggggagtggtagagtgatcatactggcattttaacatttacagtagctgacatggctatgtatctgagggcccgggtcgtcagcatttacacctctgtccagttctgcactttgcccactgtgttttctagatctgcaaaaatgtgagactaggagagaaaaaaagttctgacaagattttggttggattagcttccagataagcctgctatagcttggaggctgaatactagtcatgtgaacagagggtagaaaatgggggcagcatctactaattgtatctctctctccctttctctctgtctctctttcacttcacacacacacacacacacacacacacacacacacacacacacacactttcttgaattgtggggatagacagaaggacaaccctagcaaaggaacatggagacaatgaaattatgtctgagctaattattgctagtgccctttaccttgtcaccatcggtactcattctttatcttgtttcactccctcttctcattcttttcctgcctcacttttagaaaaaataaacccaacaaggaaaaataaaccatgatcccagacctcaaggcacttgtacaatgtttcagaagacattgcccctaaatccttttgtaacaaacatttggagagacaagacttcaaactggggaccactacaagataatgtattattaattgctaagaaaaagagagcatccactttttttctttcttatgaccgtttattattccattgaattgaaattaggagacacaattgtttttcccctaaaatacatcccctccccaatattctggtagaccaaattagtgagaaaaccatcccagtacttcactcatgtgaaatttgatgtgacggcttttgctagctattttctccatcacatgaagttgaagaaagctcatcttgatcttggcctagatccacaatctctttggtattccttcactagtccacattgggggtatttaagcagtgagtgctttctgcaaatatgtgcacagttccacgagcaatccttactgcctcgatttggattttatgtcttcatttgcaggaagcctttgccctcataaatgagcctggggccctttgctacagtggttggagtgctctattgctaatgttgttttgataatgattgaagcatttaaaaaagttgttctttattctcagtctttgcattgcctcgtttcctaaatttaatttacttagatgtgcttagtaaaatggggcagcacaattgctttttgtttctgcttaattaattctttctgaaaaactccactaaaagtagactttcctttctctttttctttttcttctcccctaccttataatagttatgatgataacaatagtgaagatttattaagtgcctactatatgatgctgacttttacataattatctcatttaattttcccaacagccctatgaggtctgtactgtaattatctccattttacagatgaggaaactcattgatgccacagcttcttctgagccatcacgtgacatggctttccttgttcttaatgtccttgaggtaaaacaaaattgagaagttggatttgtggttcttgtgaagaaaaatggaatagaattctgaatttttcgtcatctcactac

SEQ ID NO: 139210 - DNA, 1016 bp, Homo sapiens
tactataaattacagtgctgggttcagtttggtgatatgtattatctgtgttctcctttactgcttttgtcagcagctcccttgagaagggtgaagtggagagcttggagtcaataccctggaccccagcagtgatgtcatgtgaggcaaaacttgatgaatttcattcctaaattaagaaaatctggacacataagttaaggacatgatcaactgaaattcctagggaaataagatgttgtaataaaaataaattttctggtgacttagggctaactagtctcccctcattttttaaaaaaataaaacatccaattattgaaaaactgtctaaaatgtctgaatatgctttctagtatgacttcagtaagatttcttgaaacttgcttttctgaggaccttgtaaaactttaggggagtcatccttatatcccatatacacatttttttttcattctaccttcttagtttgctttattgcactcatttactatgcagtagctatttatctctgctagtccctttagacggtgaacttctttggagaagggattaaatttctcttgttcaaagtcgtacctccagcatgtagcacagtgcctggcatatagaaggtatgttagactgggttctctgagaagcagatgccagttggattcatatctaatccaatatggaatagatgtgcaagggatttattgggggaaaacacttatgaaggaaaatgaggagggagctgaaggaggccggaaaagccatcagaccatggtgcaggtctgacccttgtggaagagagaggaaaggaaggaaggttgagtaggaggaatcttagactgcagtgccgttttaagaaagtttggcaaggtcaatggggagtcctcaagccaaagtcccctgtgagcaaagtcctgggttacaggacttagtatctttgccatgctcagtcattggctgggagcagcccccagggaatgtggcttaggaacaatgtggtggtgaattcaaagggcagcagc

SEQ ID NO: 139211 - DNA, 1014 bp, Homo sapiens
agttcctttaaaactgaactctcttgaaattctgacattacctccaagtgaaaggggagaacatcaagcccaaactacaatgggccccttgagacacaaagatgaatcactcaagggtccttccctcaaggaacttaaatctagtggaaataaggcatgcatatataactttgttgcaatatggagagtgtgagaagtgtctttataaagactggagagttccgtgggaattcaatggatagaaagcttttggagttcatctccttctgctcccataaacattctttcccatgggaatccagtccaaagataacgagtagtcatcttatagcagggttcacatagctccttgtcatctggcttctgccactctccaccacttcaattttccctttagccttgccaggttccttggcagtgcctgaagatgccacccactttcacacccctgtgcccttactccattttcttggaggtttttaaagaagtagaatgacataatcagatatgtactttagaaatatttctctgggacttgggtggagaagggtatagaggcaggaaggccagtttggaggctgttgttagttgtccaagtgaaagaaggtgaggtgatgagggagcaatggaaaggaggggaatgattacatttagaaagcaaaatcagtagcatttggtgacatttggctatagcagatgagggtgtgagtgaagtatccagaatgagtgaaaggtttctagttaatttgagagtccattttctataccaattcatgaactctggtgcagggaccatgtcctgttcattattatattccttgggctgggcatagtccttggcataaagtaggcattcagtaaatgttggatgaatgaattgttcaccactttggcaaggtggatataatccgtgaatttgtattctcagagcacatgttgaccactggttggtaaagtggtccaggaagaacctctttatgggagagtgtagtgatctggggattcaacctttac

SEQ ID NO: 139212 - DNA, 1009 bp, Homo sapiens
cgtgcaaagtggtaaatatatggttttcacagatgagatattctctgaagaaatgctgtcacacttgtttatgacaaaaagaccagttctaacatttatggctgtggggcatctctcctctgatgcattatcagagcataccagtgacaactgtggtgtgtcaagagattagtgagttagagtgtggccttcatggaaacagagagaaaggaaccctgggggtcaccagattcagcctccctcctacctagtgtaggagtccattctgtggtatatgacattgctacccaaattatgcctgaatgcctcaagagacagggagattactatgtataggaagtaggctgtcattgttgactaatatttgttcattaattcagcaaccatttattgagtgtgtactatgtactggacactaggccatgtcagggaatacagagatggccaaaatatagctcttgcccacagaaacctataacttaatagtagggataagaaaggtataccaatgactacaaaacctagattgcaaaacacattgttagagaagtacaaaatgaacagaaaattctgagagataacagctcaaagagttcatttggagaggaggggagaaacatgaaagacacctgagagagaccttatggatgagaatattttaatagctgaagctagggaaagagtgcttcagagacaggaaaagcatgagcgaaacagggaagcaggaaatggaggcatgtgtttggaaaacattaaataagagtttaatttaattctcacaacgaccttgagagtaggtgttattgtctccattttataggtaaggaaactgaggctcagagattaagtaacttgcctaagatcacacagctaagtggatggccaagttgaggttcacattctggtctgtctgatttcagagtttttccctttgccactgcatgccatccatcaggaggatatctgccattagttggcttctggagatacaggggcatatatgtaaaag

SEQ ID NO: 139213 - DNA, 1094 bp, Homo sapiens
ctctcccccctactccttctatcctgtgctagaggaagattcctagtaaagtctttagccctgaggtatgagggcattactcacagagtgctatacatgaagacaacacgtgatgaaatggcttaaccaaagtagtaactcaccaatgatgaaacatttagatattattaggcagaaacatttaggttgggtagaggaggaaagagagtgtattagtttcctagggctgccatatcaaattacctcaaattgggtggcttaaaacaactgaaatttattctctcacagccctcatggtcagaagtccaaaatcaatgggtcagcagggctgtgctctcttcatagattctcagagagaatcattcctcgcctcttccggcttctggtggctccaggcatttttcggtttgtggttgtatcattccaatctctgcctccatcctcacatggccttttactcttcttgtgtctctcctctgtgtgtctcttataagggcacttgtctttggatttaggatccacctagataatccaggaggattgacacctctccagtccagtcctatccaggtgttctgggttgcctccctccccactactccttctgtcctgtgctggaggaagatctctagcctgatccttaattacatctgcaaagacccgtttttccaaataaggtcacatttacaggttccagggtttaggacatggacatatattgggggtgggggggggtgacaccattcaacccaccatatagaggagagctttctggggccttctgaatcataccagtttaccagaactctctactgtaaggaggaacttgtttgaagaaatcttaaagttagttgtaaagtgtcagaaatgtcagtgcgcttcctgagagggatgtgggtggcaactactgttaactcattttttaaatggttaaattgaggacctgggaaataaaatgacttaaagttagttgtaaagtgtcaaaaatgtcagtgtgcttcctgagggggatgtgggtggcaactactgttaactcatttttcaaatggttaaattaaggacctgggaaataaaatgacttacccaagtcactg

SEQ ID NO: 139214 - DNA, 1022 bp, Homo sapiens
aaaagtgcagcctaagtatcccctattctatcctttttctcttcttaaaaaacaaaaacaaacagaaaaaacattcacagaggtcatctggtgcagtgaggtgggaaaaactaaaaaggaaaaaaaaaaaaaaagcctaggttgccttcacatctgctagtcattcccactagtgtgacttcaattcagcaagtttttattgagcacctgtgatgggggcggtgctaataatcgttaacatttattgagccaggcactgtgctaagctctttatgggcaacatcctacttaatcctcacaacagcactaccaggtggatagcattgtttcccccattttacagatgaggaaactgaggcttagagaggtttaatgacttgttcaagatcaaatagctatgaaattaatcaaacccagttagtctggttccagagccatgttcctaatgattactcttgtgatgggttcagcatttgtaggaattactcctcaattcagttttgagaacccagtatgtgtgagatgctagggattcaaattcaaatactcccctctccctgctcttggtaggagaagcagacatgtagacagacgacggccatgtatggagtggtccccacgttgattgagggggaaagaggaagaaatgggaagaccagtggcttgaacctgtgggaatgctacgtcacgaaggcagcccagcagcctggggttataggtatttcttttcctgtttggtgaaggtcatcctttgagttgaactgcctcaatgattgtatcaacctgtttccatcattgcctcaacccagtgtagcatcagctaccttgaacccagcactcctaagacatgcatggtcagcacagtttgggccaactggcctcatagtgtcaccatttccctttcagttttcccttaaaaagtaaaaagcaggctggacacggtggctcatgccacccagcactttgggaggctgaggtgggcagatgacttgagctcaggatttcaagaccagcctgggcaa

SEQ ID NO: 139215 - DNA, 3628 bp, Homo sapiens
attttcaacagagccaaaaattagtccattattttcttttcccatccacacaaacctgcctctccttaacgttctatatttctggtgatggtatctctgtctggcaccaactcgaaaccttgaaattgtctttgatttctccttttacccatcccacacccaaattaagtgactaaatcttgcaagtctacctctgtctattatgtctctcactcttatggccttggcgtgcatgccctctatttaagtataacagactgagccaatgaatgagaatgtgatattgaatgggctagggagagccagtaggatctctgctcagtggctaataatttgtaactagttggaaagtactgcctttgctgccttagatgggtagaacctctagtcttggccttggcttaatttaatgtgaccagaggcagctatctcctgagatcatttggctcttcccatagggaactaatggtttcccactttttcttttgctggcattctggggtatatcttacttggccatctccagaagtcagagtggaactattgaagagtttcaaagagctgtggaagaactgtgctcagtgtttcaaatagtcctttctgttttcagaaacaggttttctgctttgttttcaaacttcaaagtttatttctgaaataaaggattattttccccatggtattctgaaggttttatacaagtgttaatttctaaaacctaagtcatttcttggctttaaaacttcagtgctgtgggtcaatttaataacgttgcctgaagggttttttggccttcaaaagctgtcagattgctttttctttgttctttgagagtgtaaggttgcctcatttatgaagcttgaaggagatgttggaaccagcatttattcaatcattcagagtcttttcccaacaatatccagttttagcttcaaattagatcctagtggtaatgaaatttactaccaactaataattcggggtaaaatgggtaagattcttgaaaagctcctcaacatttcatagagtagtgataagaagtagcctaggttactctaacacccacagttaaggggaacaacggatgttctgtgcactctcatcacagccctcctggggctcaatatacctctgaagctactgagggccctccttctgtctgttggactgttctccgcatcttcctttctccccttcctcctaccctcacaccctctctcaactgattataatttagaacagaaggtgctttatggttttttatatttattaaatggttttgtttcttgttctctcttaaaaaaaagatgagtggaatgttttatattttcctctgcattttagttttaagctgtgtttcctttccccgtagcttctgatttccatctctcctctctcttcctccattttcctctgccttctccacttctgtctgtcctcaatggagagaaaacaggctttcaatttctgcccacatattttatttgggtacctggtttacttatcttgagatattgtaaaatactattctttagtttgaaaatgaagagccctaaaatatacaccaatgaatttacattccattttctaagaactgagtatttaaaaagctttctatacagatagaacaaggctagatgacctgacttgtgtacctcagatcattgctatgtagtttacattctgtctcaccttgtcataactctcaataaatgaaaattgcatctttgttcttagaaatctcttttcttacattgaatgctttccttttttctgaagataagggagcccctttgaaacagcgctagtgtgggttaaaactgacacctaccttgtaagctaaccaaattataacctgcttttccctgatgaagttatcacacttcagggacattgttttgcttgtggggttttattgtcccagtttcaattttgactgcaggttagagattgtattccaattggactattccttggtattttttctctttgtctttatacttatggggctctgttgtttgtcctgtatctattatctcttccaagcttggccaaggttgttaggttatgcacttatgtataaatatttaacaagataagttagacaaaatgtgcttgaagacatttaagccctgttccccaccttcccaccaccccaccccccagctcatttttttgcatagagtcgcagatagttgctttatctcagatgtttagatttggaggacattcctttgcactttgcttgatggacacaattaaatggaagccttttagtcaatcttgactaccaaaatagtagcaccaagtaacagataacattaggttcttcttcctatttttttttttttctaactggttatccaaactcccttaagccagagagttttaggtatgagattgtgtgttttttaagaaaatattacggataaagactaatgttctcaagtcaggaataacaattagtaccattcattaatcaggaggcatgttttgactctgggtcctggctaggaaatataaactgtgaaagtcacacatatatatgaacctcaagcaaatttatgacttgtcagccttttaaggttaaattcttaaccccagatcggagctggctttatatgtggagcccggcacattcctctgggccactgagcacgcccctccccagccctttgcttaacagcagctagtggcctaatgagcaagaaggatttctgtctcttatcagctgcctaaacagcaacaggaaggctgatatacggagtacaggtcaaaacctgagttcttgaaccaaaaagctacaaggtcagtttaaaactctagatatgtggtaccgctatagtcatcaatacctgtcagtaaaggagttagacacttgagttcaaacaaatagtaatagttgtcaaaagtatgaatcgtctaattaattttgctaatagttctttccttctttgtttagttcttttagaaatagccttcatatactctttaatgagcttttagtttgtgcctggaggttgttatggtcgtgtaggagtgtttgattgtcatctagtgatgatgatggaggcgaggatatttatattttggcccagattttggaaggggctgccaaataaaggtaaatagatatctactactatttttatttctttttaaactggggtttttttgcatatgcattcaacttgccatggagtcagagaaacctttgtgcctcctcatattgcactcagatgtttttttttaaaggagaaatcctcattgcctgtttcttagatgcacttggaatccaggctcagattcacgtagaataaatattttagggtattcagtgcccatcatagtgaaagccccttgactttcatcttctgcatttgcatgttttcagagacaataatgaaaactttttttcagattctgttgtgttattgaaaatcctatttacataaacaggcattgttgtggcttagggaagaatgtggggtcccattctttagctccttgtatatctttgctaaggctcgtctaaatagaagtaatgacgctttagtctaagcagcttttctcatttaggtaagcagggtggtttgaaatttcagtttactggataattgagtctctt

SEQ ID NO: 139216 - DNA, 1053 bp, Homo sapiens
ttcacaatcacacattacatttgtcttgtgaaagccttgccctcatatagctcacgtacacacagtgcaaccactcgtaaagtgtctgtagcttctgagttccagcaactttagtggttccaacatggtggctcctctgtccctcccccagggcagtactttcccaatgtaaagaatgaaaactgtaacaatatgtagcttttggagctctggtctgtattctgcttcagacttggccctgatggctggtctctgaaacatgtggttccaagtaaacgctaggaatacttgtgtaattgggctgatctttcataagtgtctatggagatgtattattttttggtttaggggttggggagggttgtataattttctgtttctctggcataaatggtttctttcatttctctgttgtttaagagattgccttcatcagtgtttctttcaacataagcttgaaactccttgtattccagttgattttttgacaccactttcaggttggtggaatagtttagaaggaccacgagggaagattatggaaattaatctttactgagtgcctactatatgtcaattactttatatttaacctctcatttaatcaacacaggaaacctgaaaggtaggtggtgtcagctccattttacagatgaagaaactgaggctcagaaaggtttacttacccaaaggttgtgtaagtggcggagccggaattttcacccaggtttgtcttactccatagctcatgctgtttccagaatacctactggagtatgagaggaagggatatagtctggatataaagtatttgacttaaattcccatactctgtcaacttctgtgacactgtgtactctgggttcccttcctactcgcttcagtctttgcttgtttgccctcttcctcctacactttggatgtaagtgtcccagtagtgtttgtcttttgccctttccgttctctctttgcttattcccacatccattcccatgacttcattatctttgctctttgaatgattcaacctgacctcttccttgctcttcagct

SEQ ID NO: 139217 - DNA, 1115 bp, Homo sapiens
tttgggttatacccaaggatgatgaggagccttgaaaacattttaagaagggaaacattattcagttggaggatgactggagagtgagcggtggcagggagttttagtaacacaggtgatagggcaggggaccataaataggagaataaaagctaaacttgagagaatagagggagtagaatagacatgacttagtgactggatatgaggacagaagggagaatctagaacttttggtttttctgggtggtggtgctgtggcacataataggtgcttggtaaatatttgttgaacaaatgagtgtgcttgaaatataggaggaacatgtttttaagggctgaaataatcagtttggtttcaaacagattgagtttgaaaggtcctttgatgatggaggtagaaaatgtctgctaggtagttcaagttgcgttttggattacaaaagagggagaaatcagggatggagatatatacttggaaattatcagcatatagatggtaattgaagccctgggaacagatgagttcactgggaaagagtgtatatattcttctggagttaaggagaagcacatagttgggactcatcagcatataggcttaagttggaagtcgtgagtgtggatgatattttccaggcttttgcatgtggcatgtattaaaatgtattttgccaacatctgatgatttaaaaaaaaaacctgccaaagacttcaagaaccctcttgattaagagaaagtatgagtatatgttgtcatgatccaagactctgcaaataagataatgtactaccaaacacacacacgtgcatgtgcacacgtgcatacacacacatctctatgtagaggaatatattagaatcaaagaatcagacttctattattcttgatagtaataatgaataattatgcatgttatttaaatggaaaggctggacatggtggctcacacctgtaatcccagcacttttgaaggctaaggtgggaggactgattgagcccaagagttcaagaccagcctgggcaacatagtgaaaccctgcctcttcaaaaaatagaaaaattagctgggcatagtggcatgtacctgcagtttctgtgactcaggaggctg

SEQ ID NO: 139218 - DNA, 1067 bp, Homo sapiens
tacctgtaatcccagctactcaggaggctgaggcaggagaatcgcttgaacctgggaggcagaggttgcagtgagctgagatcataccactgcactccagcctgggcgacagaggaagactctgtctcaaaaataaataaataaaatttaaaaaaggacataatccaaagtgaattttccgccatggaaatttcatttgggtaggataaagggcctcatgagagttctcttaatttctgtctgcattaggccaaactttcaattagttgcctaggtaaactaattgaaagttgatgggaagttctttcaaatattcaaatagaggcccaagtaggaaaaaggataaaaaacgaagggatgatgttcatttgaaaacaaaaatcagaattctatttgcatactcttctccttaattatggctctgctccctctctcccaaaccctgcatatcagtacttacagtgtgtatcatgtcaccctgggattcttcattgctctttgtcaaactttggtttgaatgattgaagctgatggaaacatggtgaagggagaaagagttagagtgacagatatagggaggagtttaaaagccttcacttggtatatattagaaagttagctggcatacgacagatggaaaggattggaaaatatttgagtatggaaatttgcatgtgtgcagagagaatacagaaggatgtcccaattgcatttggttcagagaaatactttatctgtacttctcacttattatccatgttttttgaaatatgtagcttattcatggcctcttccagaccctatgcttattgaatgcagggaccatgtttgattcatcatgatatcctctagagtggtgagtagagtgccttgtacagagtttttaatggattgattaattagttggaatgaatgtaagaataaacacctaaagacatagtctagagagcttgaccactgtccagtgagatcctggggtggcatataactatagaacattgattctctgaatgtatcattgtctaaactaatttgcagcagagacagaaggggtggtgaatttgaag

SEQ ID NO: 139219 - DNA, 1256 bp, Homo sapiens
gcaactcccaaaagattgagggatcttgccttggaaggccttggaaagtgcgagaaccaatccagaaggccaaatgcctgtatgggtaaaaggcagtcttgaacagccaaaattgacttggagtttcttgaaatagatgaaacaacataaaaataaaaagcaatgtgcttgaaacaaagagatagtttggtatttgtttttgttgtttttactgtgagaactagcctccgtatctgggttgccagctgcggttccccaattagtttgaagcagttagcggtcctaatgtccagagagagaataataagtgaggtgtggaagggttttttctcttctgagattgcacgagacatttgggtgaccaggtgatttgttaaaactttgaaactttgaacaatacaaaaaactctgtattgtgtgctacttggaacagttagagaattctttcaaatgtggtctgaatagtacacgaatcctgatactgataccaagctgtgcttagagggagccatcaatctgatggaggacatggctgatgattggtggggcaccttgggctgaaaggagtctaacactgccaactccttggcagcctctgtaataggtgctggggttgcagagaggagtgagacacaatcccttttgtcaaggagctcacagtctagtggggaagcatacaagtaaacaggcttcccaggaaacttgtaggattaaaaagggtgaaaagggctagaaaatacctccaggaaattggctgaaatggtcacaatagccagcctgggcaagggaaaagaactgaagagatgaagtgggagatagggagaagtctcttaatagggccgccatcttaaaaagagtttcttaattcttggagcaaattccattttggaagcattaggaaatacagacataagaagaattttaatggttgctaaatgacgcagatggcgtcagttttgcaatgtgtttttttcttatgggctggtaggttgtatccaatattttgatgcaatatttttgagcattctgctacttccatctttagagttgcaatgtttgctgttcactgtagcctagaaaaaggcggcttattactgatctgggggaaaagagtcctggatttgtctggtatgagacaagacagaaaatatgttttctccctaaatgacagctatcaatgaccacgccaacttcagtgtttgatgcatatacaaaagcatgggtcttaagagttatcttattactcatttctaaga

SEQ ID NO: 139220 - DNA, 1059 bp, Homo sapiens
aaaaatcctaaagggaaaagccctccaggctgtaggccaatgagcggcgggaaggaggagtgaggctggggaacttctcccagagccagtcagagcggacggctgctgggaagccaatcagcgcgctcgagcctgcagcccctctgcagtagttatgccagagcgccctgtgtagagcggctgcgagcgggcagctgggctcggctgccgggagccaccgcgcgggctccgcaccctcctctcgcactgccttcgcccggtccccgcgccgcggtgccccagtggcccccgccgcgctccacgccgcgcccccgcaccccgccggctaccggccgcacaaccgccaccgccccctggccgcgcggctcgcctcgccccgccccgtccctcctcgccccgccccaccccagtcagccccgccctgccccgcgccgccaagcggttcccgccctcgcccagcgcccaggtagctgcgaggaaacttttgcagcggctgggtagcagcacgtctcttgctcctcagggccactgccaggcttgccgagtcctgggactgctctcgctccggctgccactctcccgcgctctcctagctccctgcgaagcaggatggccgggaccgtgcgcaccgcgtgcttggtggtggcgatgctgctcagcttggacttcccgggacaggcgcagcccccgccgccgccgccggacgccacctgtcaccaagtccgctccttcttccagagactgcagcccggactcaagtgggtgccagaaactcccgtgccaggtgaggaggggtcccttgagcgtgcctagcgcccagcggggagcaaggcgcgcgtggtggctgtaccctgagcgcgctagccccgccgggctgtagtcgtgcgccctgcagctgggcacttgggagtggtcggtgtgcctggggcctggctgggtctactgagggagggagagagggtgtgtgtggacggagcccacatcccccagtctcacgctgctgtcagggaaggtgtgagcgggaggaaccgtggggatcgccttctcgtgagcgcccgt

SEQ ID NO: 139221 - DNA, 4421 bp, Homo sapiens
ctctcattttgcccggtgttcaaagtctggtatgcttaattccattttgattgtgcgtcttaaactaagacatcattttattctacagagcgctgtcgggctttggccttgaagcagcccgccctcaattggttctcattagcggtggaatgagaggagaaagcaagataattgcaccgtatcttccgcacatttgcgcgtgtattcggtggctgctaccgttaacgatacctgccaagaaaccctgatttagtgggtgaagagggcgcctggcaagggcgaaagcctcccaacagtagcacaaggtgctaggggttaaaactttcacatgtgcagagagtaagtcgtgtttctatttcttccctcctcgggccttaggaacactttcaatctagcggcgaggtggcgcgcatgcgcgcgccgggtgggggacacccctgtcccacggctccgtgggcctcgtcgtctgtctccggtggggggctgaggcgagcgccgcgggagcgagatgggacaaggtggtagtgagtgcgccatcctggcccggatgccggtggcacccgcaccggctccggccacggcctctgcctgggccgctgtcccaggcgcgcctttaattaaggactccagcttgggggaagagagaagggaaaatgccgactgcggtccgcccgtgggtaactggggctcggtggggttttcgctttggcggggtgggggttccgtttcctaattcctgtgcgggccgggtgggcgggggcgggcttttttccttgggctattaaaggcagaggggcgggcttttcccagggatatagctacggacagagggccaaggggacggagcgctcctcaagtggtggcagggaggctcgtggccccgcgtcgctctggacaggggcgctttggggtgagatgtgcgctcgcggccttgatccatttagtggacgctttttctcacttctcttccccttctggctccgcgggagactgcgctcgcacccggccccggagcgctcgagctgcgcgctgggacactgggtatacgtgtggaggggacacccggagagggcggcccgtgcgggatccccgcgctctccacctgcgaggggcgggccggagctgggtcccgcgcgcggtttcccgagcgggtggctgggcaagaagggagcccttcgttggggcagctgtgatccggtagagttgactggttgggtgggaggggacggagcgggcgggacttgagaaaagcaaagtaccagagtgcggttgaggggtagcgggcagcgcgcgggaaacgactccccttttcttctccaccgttgacctttaggttcctggaaaactttggtggtgagggtgtgaaatgagggggtgcacgtggagggaaaaaagggactcccctccctcttggcttctatcccaccaacccgggaatggagggggagggaggcgtgggcttggcgcgtttttggtgctttgaatggagaactccgtttcccatgatgctttgtttctttctctttaatttcggcggcggctgaggctgcacgaggactggagcgcgtggtgtgagcagctggagcacaccctggacgcgcgggctgctcgcggacttcaacgggagcattaggtaagggtgtgagagacgcgggaagaggcaaaagggagccacaaaggcgtacagggaaggacttctttctttcttttccttattattattattattatttgcaatttaaggggattggagagtgactgcccagcgtgcgcgagggatgccagatgaaccgctaattagcaaaaggtagtaactagaagggcgccctgtctgatggctgtggggctcagtttggccaggttgggttggcaaatactatgcattttgagtcaagtttggagtattttttttttaatggaaaagaaatcttcacaggtgtagaaacccaatttaaggggaaaaatgttatttttctcatttctatactaaatccattcttccctaatagaaaattgattccagattgatgtataagttttataaatcagtttagtttgtaaagacttctaaagactcatttagtggcataagatatcgtgacgaaagttcaacatttaaaattccctcactcgtttaacgtattacagattctgtcccaaacgtttttgtttttcttttaaacaaaagttaccccatcatggaagagataggggaccctgtgagcctttttcacatagaggctcacttccttgctgtatgttcttaggtaaaataagcacttggaaatgggagaaggttttcttatggaagataatgacatgaagggaagaagagctaatctgcctactttggtttaatggagaaaatgggtccataaatgtttaaacagaagtagagccctttgaaatagatcaaaatgtgacatctctcagccatctgtgcattatgtgaagactgtaaggctgtgtttcttaaaccagctctaaaatttctctcattttctattaatggggtgggggctgggaatattcatttaatctaacagtcactttccgtatggagcccaaaagctctgaatgatctgaagactcgaatactcatcctgggttttacatgctcctttctctaggtcctcctcttataaaatcagggtggatagaatgtgcctgcaaattactgagatgcagatatcaaattttcttagatggagagggggagtccaaaatctgcttatacataagaattggactttttgcagttgccagtgttattcgtgttcaattctgtgtaaataattgagattattaatatttctcaggatttggttgaaaccacaaaacctagcttagactctgtaagccaaaggaaagcctgtttcaggaatattaactagtagtttacttgtttagtttctaatatgtgtgtgtttgttttgttgttttaaccaggtgagtctgcatggatctgtgaggacggaaaagaagagctcctggaagacttaaaattttgctacaggaataggccttggccatgtaaaagtgcttacagtgcaggtagctttttgagatctactgcaatgtaagcacttcttacattaccatggtgatttagtcaatggctactgagaactgtagtttgtgcataattaagtagttgatgcttttgagctgcttcttataatgtgtctcttgtgttaaggtgcatctagtgcagttagtgaagcagcttagaatctactgccctaaatgccccttctggcacaggctgcctaatatacagcattttaaaagtatgccttgagtagtaatttgaataggacacatttcagtggtttgttttttgcctttttattgtttgttgggaacagatggtggggactgtgcagtgtacagttgtgtacagaggataagattgggtcctagtagtaccaaagtgctcatagtgcaggtagttttggcatgactctactgtagtatgggcacttccagtactcttggataacaaatctcttgttgatggagagaatattcaaagacattgctacttacaattagttttgcaggtttgcatttcagcgtatatatgtatatgtggctgtgcaaatccatgcaaaactgattgtgataatgtgtgcttcctacgtctgtgtgaacacaccttcatgcgtatctccagcactcatgcccattcatccctgggtggggatttgttgcattacttgtgttctatataaagtattgcacttgtcccggcctgtggaagaaaggaggatttttatcgtcttcttattttaacttttaaaagccgtaagttctgatatttagtcattgtaaaatgatctgttttgctgttgtcgggtggatcacgatgcaattttgatgagtatcataggagaaaaattgcacggtatccatctgtaaaccgcaggacctttgttggcgacattcctgatcagcgctacagtaagctagatggtaaaaaatcctttctctagttgctgctattaaaaaataatttgaaatatatttggatttctaaaaactatgatagctaatttataaagtatgtgttttggaactttggtgaatgatcagattgttactgaatgtgaatgaacctcaaaataaatgaaatttatagatctgaaaaaatgactcttttttttttaaaaaaaataattagcaatgctagaggagtttgtaaaatatctcttgggaggatcctaaaggaaaacttggacatagctgcttttcaagtttgcatctacataaagcaccaagatgcctaattttaggaattttattaccctgacaatatttggatgacatgtactaattttgttttagtacacgtgctcattcttaggaagggaatgaagagttgtaaaccaatgggacacatacctttaaggaactgggca

SEQ ID NO: 139222 - DNA, 1036 bp, Homo sapiens
cacttatattaataaatgtccacaactgacccactaacaggcatgcctacactttcaataatggcttctggtttggtttgccttatgctggaacaaattacctagtcaagtttattgagaacaaaatggctaccaggccagggtagaggagtgtcattgccttaaagcatattccttgttcttgccagagaatactaatgccatactcgttctgcataaaaaaacaaacagtacaatttgtgaagagaaaatgagactggcagcttttaccccgagtctgggatttgccacattctgtgactagatttgggaacaagcccttaaaggatatcttgccaatgaaagagagaagaaaaaaaaaagagcagctcagagactgcttgaccctgccctgtgtaagccatgggagggaaattccaaaaggcttttcaaacctttctctttctgttctttgaaatgtgacatgcagttctccttaccctccccccttcacttttcctctcttcttttgtggccttttaaaagatacctaagctctgaaaatagtgagttgttttctttcaatatggggaatgaaacctagcagatgaataaagaagaattttagaacaagcactgacctgagagacagggtcctcagttttactactatgggctgtgtggccttggtcaagtcacttaacttctctgggccttagtcataaatgggctcttcccatttcagtagctatataggcttcactgaaaggcatttcctttcagacaccaggaaattatacagaggctcagggaagagagacagtgaaaattaaaaagtgtgtgtgtgtgtgtgtgtgtgcatgtgtgcatatgtgtatgtgttttgccagagatttatgggatggttggatgtagaagtaactttttcaaggagcaaaattattaatgaaaagagttttttattttaacctttatccatacccagacctctatctcagatagagatattcttgctatctccagatataaagtgtccacactttacttgcccctgtgc

SEQ ID NO: 139223 - DNA, 1032 bp, Homo sapiens
tgttagctcccttgatgttgttccataaatctcaaagacttgccaattattttatttatgaagggaaggttaggctcctgataaagccagtatataattgaaaatggctatgctccaggattctgcaggaaaagttttaataacactcctgtaatagttaatttagtaatttcttcagaaacttgtgcgatatgttctgcttttcccaacaatttctgttataatcacaatattttctgttccatgttttatccaaagattatcaaatgcataggttgttacagaaagaagttttcctatccacctaggctatagacatgtcaatgagctgatcatgcctttgacaggaagctgaatctcacttacacaagttgctggtctatgaaagaagaggattaatgctatgtcagttaagtggcatgctctagtttgtaatgtaaatcccatagagtttttaaatcacagcatttatttttacactgaaatgggagaatataaatagttagatttctatgtaatgacttcaccaactattttgccagtcagtgaaaagttcttccttcacttgtttgttatgaatgatactagattctctgccaattcagtaacaattaccccacattgccatctaaaagaatcccacttataatagattatgaacaaacgtgaactgaattaatgaatgatgtgtttttcttgtttatttttcatggagcgtacagggtcataaataaatagtttatatcacaatctggccaccaagaaattaaatccatcatcattaaagtgataagtcagatgccaaaaagcagatggacagtggcatgatgaggccttttatgaacgtggcttatatttattcctagccaaagacatgatatgtaggagttcagaccaaaaaagcttggcaagagtgaggattagaccattagaagtaacatgtcttcctctgctcaatttctttattttctcctttaagcaattgacctcctcttaacaccaattcctgaatgaagtctttatactgggatg

SEQ ID NO: 139224 - DNA, 1014 bp, Homo sapiens
gcagagactgtcagggcctttgaagttgtgttaaaaagaaaattctagacataaatggatgagaagacatgttttctttgtggcttcaggtgaaattttgattaagtatctgaattttatattgaaaagcactgaatagtttgtagatattaccttcctagcatacagctgctactgttcttgttggtgaacgaatgcttctcagctgcaatgtagtgttagacaattttttttcaacatagtattatgaaactgttcaaatgtatagacaaattgaaacaatttagtaaattaattttaagacaaaagtttgagatttttcttgattgtgacgtgtgttgtggcaacctggatcttgaactgcttagtcctgttgatttgggaaaactgtacaaatcaagtaactggttttaaatttcttctgaagaatccatattaagattgatgatctaaatctgaaacctttcatgttagagctttccttccctttttttgactacactgtactacctataattaaaatgtgaccaaatttaaggctcattcagaaaaaaatttcttcctttacacaatattactaatttaagtacggaagttactacatttagaagaccactatcagtttgtgactttaattgataagcaggcttggagtaaatcttagtcatataatatggttgttttataaataattgggtcttaaagtctgcatttttaaatagactgtcagaagcctaactttttatttacttgaaaatggaatagaatagcaaaaattaatttattaaagacatattcctgatttttttaaactcagaaataatttttaaagtgcaccaaagtcatagttaggtaaattcgttttacttttattgttttatcaatatgtgaactttaagaaattgttcaattacagaattctgttcccacggagtattctgaagtttccttagtagcttttaccgtgttcttaagaggtataattctttatcgccttgaaagggcacctagtta

SEQ ID NO: 139225 - DNA, 1018 bp, Homo sapiens
ggtaagttggtatttctgcctcttgagaataaaaattatttaaactcattaaagaggaaattgcttattttagagtgtattgcattattaactgagtataattttaaattgcaggcttttctttttttttttctctgagccagcaaaatccaaggccgggtttatcttatttaccactcaacaaaaaggaatgagtcaatatttatactattcaattttttttgcttttcaaagagaattaaaatctttttggaggctgtttacttagaaaacaaacagtttggttaatttgagtatatattgtgttaaagtcttcattcaagtttatttttcataattctgatatgttttcatctccatcataaagttatggtcattacaaatgaacatgacagtagcctctcaaaaggaaaatattagcacttgctgaacaaagtattttactgtagttcagctgtataacacaacatttatgactttggataactttcagtgaatttcacaggagcttttctgaagctgcgttagagtaatgttcccgtagttgtcttcactaccaataaccatattagtaagatattacattgctctgttggaatagtaatgtcatctcagttggtacttatgacacattatggtttactttgaaacgattattttttgtcttttttgtttccttcctttttgtggagaacgggatctcgttatattgcccaggtaggtctcgaactcctgggctcaagctgtcttcccgcctctgcctccctgagagctgggattacaggcgtgagccactgtgcccggctactttgaaacaattaatgggaagatttatttttatttttctcatttgaacactttattaaaattacatccataaatgcacctttaatagctttgctatccagtttcattttttaaaagatgcgttttgccaaacatataactgcgtttgtagttactaaataacctcttatttcacaaagactctgagatggtagtttttggatgaaatggt

SEQ ID NO: 139226 - DNA, 1046 bp, Homo sapiens
gtagagacggggtttcaccatgttaggctggtcgcgaactcctgacctcaggtgatctaccagcctcggcctcccaaagtgctgggattacaggcgtgcaccaccatgcctggcccctaattgactttttaaggcattttatcccgtgagcctgtttgctttggctcctgttcatctggatttctaggtgaaaagtaggtcatgaacactcattcaaaatcatcgaaaactggagtactgaaccctgagtgctttcaagacaaatttcaatctgtacctggtgttgactccaaagttgctcgcttgccccaaagaaaagaacagagagataaggaggctagggcttgaggttaaagtgtacgtatcaacagccaggtgggtcagagttgaggatgagagggctcagtagagcaggaggtgtgagtgtttggtttttatgttcttgctgccacaggcaattttccaaggttcatgtcagccacaaggatcaaaggaggaaagccattctgcatgaacattttcatctcctttacacggtctttaattatatagcaccaagatggaccaggaaaaatttgccagagtactaaggcttttatgatttgatgccctgtttttgcagtttagacagatatatatttttccagtatgatttccagtttctactgaagccatatggagataccacatctgtaccatctattcttacttaactccagtcatctagccaagaaatgcaaatttccaagtaaaattatgagttagcactgcttttttgaatttaaggagatacttgaaagaaggatatttgaagaatttaccgtttctggatgaagctagctggtgagattactaagggtatctactatctacattggatagctattcttctttttttttttttttttttaagatggagtttccctcttgttgcctaggctggattgcagtgacatgatctcggctcactgcaactccgcctcccaggttcaagcaattcccctgcctcagcctccccattggctgcaattataggcgcccaccac

SEQ ID NO: 139227 - DNA, 1571 bp, Homo sapiens
cggagtcttgctctgtcgcccaggctggagtacagtggcacgatctcggctcacttcaagctctgcctcctgggttcacaccattctcctgcctcagcctcccgagtagctgggactacaggcgcccaccaccgctcctggctaattttttgtatttttagtagagacgcggtttcaccgtgttagccaggatggtcttgatctcctgacctcatgatccgcccgccttggcctcccaaagtgctgggattacaggcgtgagccactgcgcccagcctgccttttctttcttaatgctaccctatgtccagtcttgctcctcccacccttccaacatactactggtagttacttgatctctgcttttaaaagctaatgccactccctaactggaaacctttcatgatttcttactgcatacaatataatgtccagaggcctcagcctgccattcagaagtcttgtcttaacccactttttccatccttatctcattctctctcctctaggttttccaagcatcctgtctctgtccccgctgcggtgcctgtactgatgttcacctctgcttgcggctcttttttcctcctagctgcctctcaaaagttctgtctgtttttgagatccagctcaaacttcacacttcatttctgtcatatagcataacacaatatgcgttgtatttgatacacatgtgcaagccttttttctccactgtattgttgactctgggagagtaagactgtattctctttgcccagcctagcatgatgtggggataatgcatagaaaactcttaatatggtgcttgatgtcttctttgtactcaatagtgttctaataaataagtgggtgctcattgttggtggactttgaagatggaaagggcttcagctggataatagtgtgaagccttaataacaggctaggtataaattgaacagggaagtcatggcgtagcacaaaattcctctcttttggttaattagtattttagtgttgtttacaacttgagcagtttgaaaagggaggagagtaatttagagggaaaaatgacgttggttattttttttccagagagtagagagctgtgtatgcctcaaacatgagagttttcatgtttcttcagccttcactccctcagtatggttttgtgtttgttgtttccttaggtattatatttgtcaaggccccatatagtatagagtttagaattcaactgtttatcaaatactttagtgcccactttctaccagcacaatgctaggtactttgaatgtaaacatgaataaatatggtttaaccttagaagtatttaaagaatggcacaggagagctgggaaagaggatcacaattaattatgagaagtcagaaggctccatagaaaacgagagttgaaatgtgttccaccaggagagtgatgctatggaagtcaaagacaaacaatttcaaggaggaagaagtggtcaaaaaatattaaataagtattaaatgccagtgctatttatagtagattgtgtgacttacttagcgttcagtaggggcaaaatggaatacccacattgtatag

SEQ ID NO: 139228 - DNA, 1091 bp, Homo sapiens
ttcagattactgagaaatgcagttctcaaatttctgcgtaagttttgcttaattcattaaagcatatgcaactaacttgcaacatactttttttactgcttgtattagaaattctttttgtacttaatatttgtttaattacttgatccattagttcaattgtaaatgacttccttgttgaatttgttcattcagttttcatgatcgtttgaagagtaatctagaccagtgttatccagtagaactttcctgtgacagtggcaacagtcctgtatatgtgctgtctaatacagttgcaactagccacatgtagccaataagctcttgcagtgcggtcagtgtgactaagaaactgaagttttaattttatttaattataactgacttaaattttttaaggccacatgttgctagtggctactacattgaatagcacagatatatctactttattttcatttagttttccaagttacagtaagtgtattttctaggtaagtgttctaattttacaaactctttgaaacctatggtaaaaaaaaataataatgcaaaagcaaactctaaaaattaatttactaaactatttgtatttgatttttattgcatttatctgaaacattgggtggctttattgaacataccacagaccatttctcctcatttctggagacagtttcattctaaggagaaacatatgtcctaaagacccatgaactaatacttattttgagattggtccataaaaagtttttgttcatttttaagcagctgatttagaagaaagttttaatgaacatgaactggagccctcatcacctaaaagtaaaaagaaaagtcgcaaaggaaggccaagaaaaactaattttaaagggctgtcagaagataccaggtccacatcctcccatggaacagatgaaatggaaagtagttcctatgtaagtaaaaaaaactgttggattcttacttttgttgcaccatgaatatttcatttaaactatctataggtaaagttcatcatttgaaatgttaagtaagcttgaaataccgatagcatattttcatgattttttttaagttcgttttttctt

SEQ ID NO: 139229 - DNA, 1057 bp, Homo sapiens
aggatgctaataatgaaaaaccatttgaagagtttgagtaaaattgtttcatcaaatgtgagcagaaggcagcagtatagatagaatatatatttcctgaaatgtgattttaaattaaatatatgaaacaaatttatagaatttgattatttcatcaatatacctgaaggttggtatttttaagttggccaaaactttgcttttaatctcattgggcaaaatgaggaattgccttatgataactgtcatcctaaaccagagattttgtttcagatgaacttttattatctcaataatagtgtgttttcctatctgttagataaaaatgggtctgtaactaattggggagtattttttaaagtgtggatgaggaaacccatgttttaaatgggcactagcctcatccactaatgttggcaggaatgttcatcagcagtgacaaagcattttgagatttttgtctttcatcattgtagactatactgtaaaaatcatagtggaaatgatgagagagatgaagaagatgaggaacgagagagtaaaagccgaggaaaagtagaaattgatcagcaacaactaactcagcagcaacttaatggaaactaggtatgaaagttaattatatgggatctgttgtcaggatacaatacacactgatatatacatgttgaagtaatggtatgcagtaagattttttttaatcctattatgtttagttaagagcatgttactaaaatgctgaggattttgtaggcttgcatagtagttgttttttaactagctgattttgtaaccataaaaacaagctatctgctttatcaataagtgtagttgtaatgtcaaatcaataagatattcacactcctcaataacattatattgattgtgttcccctcaagcatcatattttacatttttttatcatcttttaaacaggttcatgggacagagttagaaaactgggaatgaataagacatccataactactattcttttttcactgttttctaaaatcaaaaagggtttgtaactttttactgcccaactcttagatcc

SEQ ID NO: 139230 - DNA, 1425 bp, Homo sapiens
ttaaagcagacgaaacgaagtaagctatatttctggactgaacaaagctctgctgtttagagcatttaagtttgtttagtggatccatactcaaaggaaagcataagcaaattttcctttacaatgcaaacatgccactggtggcagcacatggtaatttgtggatttttttttcatactcaagtaatggaggctagaaatgaagagaaccttctttttctcttgactttgacagcacatgctaaaaatctcttccaagaagtatgctaaagcttttcatttggttcctgttaaagttgttctcactgaccagcatggactcaggcaactggtaatgataagctatgagctccagtgcttttgccaaaattctcttgacagcacacctcctctctttccatgttatacaaaggacttctggcaaaatgattgagtccttcaagtttaaactaacatttggcaacagcaaattaaacgtttttaagatgtaaagaaagggttaccgcttgctaaggacttcagacaccatgtccgaaacctgttcctctcaagtgccctgttgtgtggaacacttcacatattggcgcacagtacgtaaggaggtctcatgtgctgtaggagtaaaaaagtctttgcataaaacagtatttatttttacttttgtgaccactattttagaaactttatttaatattttaatgttttcagtcattgctttggttatctataaaataggcttttgtgccctacttttcttcttgtagggcttggtggtgttttatcgattgtcagaattgtttttgaaagcctaagaacccagctttttagaaaggattttcacactggcatttctaggtagtgatattttcttccacttacctgctgaagcacatttatgcatttctttatggcaaaaccaaataactttagttgtggtctgcctgatactaccatagcacctcagtaccaaggggagggattttgactagttgaattattaagccaccacaataaagcagatttttaaataagaaataataatgttaacttgactgtacattgagatattctgcagctgatagagcagcattttaaaaatgtaacaggtggaaaattacactgtgcttaatgactgatttttttttaaactgcgagtcccttaagatcacgtttgtcaagtgtgtattcacacatttacttaaatcaagggactcaatgcttgcttttattttaaccatcttttactatttttagaaggaaactagctttagtagtgggttgccctgtatgttttctctttttgctcttaatatgccattgggtttttgtgtgtatgtgattttcaaaattcatgacttgaagtgcaaggacagatctagatgtttgtttaccaagctatgtgacttctcccaaaggatctgtact

SEQ ID NO: 139231 - DNA, 1631 bp, Homo sapiens
cccatgggacaacagagctccttcatttttggacaactactgtaatcattttttttttaggaaaaatggaaggtgccgggggtaatcatggccagtcaataattatataaaggagttcaaatactatagctgtcagttgatgaatttgttatgtagtaaaatgtatgactttgtatgggtttcttcagccctttttctgccactagcaaccagaatagcactttaccttttggttggctagataagtggctgactacctgtttttctcactgtggtgtgattggctaaacaatctcgcattaaaaattcaaatgtaaattgaattcacatgaaaaatcatgtttggttgtaaacctccaatgttttgattctctaatcatgttttcgtcacatgctgagtaaaagtgccttacaatgtaaaaattgtacagtacttatgttcccaagtagcatcatcatcttctgggtagtaattacattgtggtattaatatttagaaaaatggacctcagcagtgtatttactgtacatctcttaagtccttaactgtagttttaataagcatgacattatttgataagtatataacatttacatcatttcaaaaaatactgccgttactgtcttttatgcatattttagcctgaaattttgaagcgtcttttttctttcttttttctttttttgttttgttttttgttattgatattaaacagtgtaatctttgcaagcgtatattgaagattattctggagcatttattgccttaccagaaatgttagtaggaaatgttctttagagtagaaagatagacttgagtttctatacttttaagaagagctctttgttcctgggggaggggggcagggggtgaattttactttcatctcaagttattaaaaacccacaactgaagtaaattttatttcaagaatcagcagttttagaatttcagatagtacttgctcagaagtacatgctactcaagatattaagagataacaagatctgtagatctgctattgaatcagaatctgtgtacttgaacaaatgtgtgaatctcaaatatctcaaagcaaaagaaaaagtgttctagagtgttgttgcttttttaaaaaaagcgctgaagttagaccaaggtatacagttttgttctaacagacatttaggttaattgtaaagataaggaatgcattatgggtcaaaaatcaaacattcctctcatgttatgtatattttgttcctgttatattggctttattttcaaaattgtagtttgtagtattagtttccttttattggtattcttgcatatactattcattcaataaatgacttatgactttcatatttgtttgtcttttttgtgaaagtgtatactgaagcttatttgataacagcaatagtattgtgttccttttagtcttgctttatttcagagtaaaatgccttaataacttttcattaaacaagtatgggaggaaaaaaagtgtgaatttgaattcagttcaaagtttcacaatataaaagttttatcatggagagaaactgcaatcttgtaagtacaatcgaactgcattacatcttggtttttttattacatggttcagatgcccatcgtttaaatcaga

SEQ ID NO: 139232 - DNA, 1822 bp, Homo sapiens
catgtgccgcctgcgagcgtgctgcggggaggggccgagggcagattcgggaatgatggcgcggggtgggggcgtgggggctttctcgggagaggcccttccctggaagtttggggtgcgatggtgaggttctcggggcacctctggaggggcctcggcacggaaagcgaccacctgggagggcgtgtggggaccaggttttgcctttagttttgcacacactgtagttcatctttatggagatgctcatggcctcattgaagccccactacagctctggtagcggtaaccatgcgtatttgacacacgaaggaactagggaaaaggcattaggtcatttcaagccgaaattcacatgtgctagaatccagattccatgctgaccgatgccccaggatatagaaaatgagaatctggtccttaccttcaagaacattcttaaccgtaatcagcctctggtatcttagctccaccctcactggttttttcttgtttgttgaaccggccaagctgctggcctccctcctcaaccgttctgatcatgcttgctaaaatagtcaaaaccccggccagttaaatatgctttagcctgctttattatgattatttttgttgttttggcaatgacctggttacctgttgtttctcccactaaaactttttaagggcaggaatcaccgccgtaactctagcacttagcacagtacttggcttgtaagaggtcctcgatgatggtttgttgaatgaatacattaaataattaaccacttgaaccctaagaaagaagcgattctatttcatattaggcattgtaatgacttaaggtaaagagcagtgctattaacggagtctaactgggaatccagcttgtttgggctatttactagttgtgtggctgtgggcaacttacttcacctctctgggcttaagtcattttatgtatatctgaggtgctggctacctcttggagttattgagaggattataagacagtctatgtgaatcagcaacccttgcatggcccctggcggggaacagtaataatagccatcatcatgtttacttacatagtcctaattagtcttcaaaacagccctgtagcaatggtatgattattaccattttacagatgaggaacctttgaagcctcagagaggctaacagacataccctaggtcatacagttattaagagaaggagctctgtctcgaacctagctctctctctctcgagtaataccagttaaaaaataggctacaaataggtactcaaaaaaatggtagtggctgttgtttttattcagttgctgaggaaaaaatgttgatttttcatctctaaacatcaacttacttaattctgccaatttcttttttttgagacagggtctcactctgtcacctaggatggagtgcagtggcacaatcactgctcactgcagcctcgacttcccgggctcgggtgattctccccaggctcaggggattctcccacttcagcctcccaagtagctgggactacaggtgcgcaccaccatccctggctaatatttgtactttattttatttatttatttatttattttttgagatggagtttcgctcttgttgcccgggctggagtacagtggcatgatctcggctcagtgcaacctctgcctcccgggttcaagcgattctcctacctcatccccctgagtagctgggattacaggcgcctgccaccatgcctggctaattttttgtatttttaatagagacgaggtttcaccatgttggccaggctactctcgaactcctgatctcaggtgatccacccgccttgg

SEQ ID NO: 139233 - DNA, 1188 bp, Homo sapiens
caaagtgctgggattacaggcgtgagccactgcgcccggcctaatatttgtattttttgtagagatggtgttttgccatgttgtccaggctggtcttgaactcctgagctcaagcgatctgcccgcctctgcttcccaaagtgctgggattacaggcatgagccaccgtgcctggcctaggtagacgcttttagctttggggtgtgatgcctgccccagtatatagtgaatttaattattgctagagctggctgtttgttagttttctttgaacataagatactcattgtttttagtttgcaaatccctcttcctttttaaaaaatttctttcccttaaattgtttgcatgttagcaataacaaatgcttaaatggtgctatgtgctagatactcttctaagccctgttatgtatattaactaattttttaaattacacaaatcagagaggttaagtaacttgcccaagattacccaacaatactaggatttgaacctaagtttgtctcaccccagattctgctcttaatctctaaacttttaagttagtagtgacaatagtaggtatttattgaatacttaactatgttttaggcgttgaagtaaatattttgcaggcattatctaatgtaaacaccctaaagttacataacaggtaccctttaggtaaataaacactagtatgaccttggaggcacagatagttgaagtaacttgcccaatatcacttacatgaaattggccctcaaatgtgtctgatacaacccatgctgcttgtaactatcgttttaaactgccagggtaaacttggacacacttgagctaagaaaaagcttttagatttttgcaaattaatgtgaaagatatgctttatgtggatataatatcttctaaatttcggggatggtagtcctagaaatgtaatcctgccctagccgagcttaccctgccaataattttttacagaattggtaaaacggagcaccttttttttgtccttggccacactgttatcaacagggtgtagattgacatcaatctgtaggtgtaaaccagaattactctttgtgaccaccaggaaatagagcagttcagttcaggggtttctttctgtgaatttagcactgtgacctgcatactacaagtctactttgttttctatccattgtttgtatctgggtattgcaa

SEQ ID NO: 139234 - DNA, 1887 bp, Homo sapiens
cctgcacgtacccattgccaagttctgacaactgtctgtctatagccaattatgcatttcttaaattagaacccccccaatatacccaaatatatatatatgtgtgcatatatatagtaagttgtaacaaagttgtgaattcatacctgaagtatctcaagtgatgcaagttttatgaatttttgtttatgccttttgggaagagttgtattgacaaattttttatgcttaaagtaaaccataaatcaaaaaaataaaatctaggatgcaataaaacaaaacaacttcttgacataagtatggtatgtaaatctgttttgattggaaatcaatttgttatattgccagaattcctgttttagaatacatctctgctgatctgtctgtattcttagactgcatatctgggatgaactctgggcagaattcacatgggcttcctttgaaataaacaagacttttcaaattcttagtcgatctgcagaacctgtagccaggcactgaaccattttgatagatgcagtaatcgttgcaagtgtatatttcaaggagttctggctgggtcctagtttatgcttgtggcagaagcagtgagtaactgggaggaagttggtgagtaagcttcaaggaagaagtcatttttagtactctggatcttcctgattttaaagcactacaaaatggtgcattttcattcttgtcaagtgataacagatatattctgatgagcctgaaatgaatatatattgtatcatttttataatatctagcaaggtttgtattttcctagaacttgaactaaatttcagttcataaaatttataaaatacttagttgttgtaaaatatttttggaatgttcacataggtgacacacaaatgtcccattttcattctttctatagtaaatatgttctgatatgtgaaggtttagcagatgcatcagcatttaatcctagaggatctggcataatcttttcccccaagaatagaaattttttctgcttatgaaagtagtacatgtttctttaaaaacaaatcaatattgacttctgcctgctgtatagcactatgcctccacctggccatgaccaggggcatgtcctggtccacctacctgaaaatgtttgcaaccagcctcctggccatgtgcacaggggctgaagttgtcccacaggtattacgggccaacctgacaatacatgaagttccaccaaagtctgagaactcagaactgagctttggggactgaaagacagcacaaacctcaaatttctcagcactggaaacctcaaaatataactgaattccataaataagattttaagtcttaaatatgtatttttaaatgtattaaaagtcaagctgcttgtatttaagcacctaatacaatgcttaggttgtaaaaggagatgctcaataggtactaactgatatattgagatttaattatggtttgaccaatatttattggaaaccgccaaagcttaaatcatcagcttcttgaatgtgatttgaaaggtaatttagtattgaatagcatgtgagctagagtatttcattctttctggtttatttcttcaaatagactttgaatataatggtgaatgggtattataaattaactaataaaaatgacattgaaaatgaaaaaatatatatattaaagtgtagaaagtgaccaggcgtggtggctcacacctgtaatccaagcaccttgggaggctgaggcaggaggatctcttgatcccaggagttcaagaccagcctgggcaacatagcgagacttcgtctctaaaaaaaaaaaagagagagaaaaaaattttttttatttaaaaaaagtgtagaaagtgtcaagaccccacttcttaccattatttggtatatt

SEQ ID NO: 139235 - DNA, 1057 bp, Homo sapiens
agagtcttgctctgtttcccaggctggagtgaagtggcgcattcttggctcactgcaaccttcacctcccaggttcaagtgattctcctgcctcagcctcccaagtagctgggactacaggcatgtgtcaccacacccggctaatttttttgtatttttagtagagacgggatttcaccgtgttgcccaggctggtctcgaactcctgagctcaggcagtctgcctgcctcagcctcccaaagtgctgggattacacgtgtgaaccaacccgcccggcctgttgttttcttacataattcattatcatacctacaaagttaacagttactaatatcatcttacacctaaatttctctgatagactaaggttattttttaacatcttaatccaatcaaatgtttgtatcctgtaatgctctcattgaaacagctatatttctttttcagattagtgatgatgaaccaggttatgaccttgatttattttgcatacctaatcattatgctgaggatttggaaagggtgtttattcctcatggactaattatggacaggtaagtaagatcttaaaatgaggttttttactttttcttgtgttaatttcaaacatcagcagctgttctgagtacttgctatttgaacataaactaggccaacttattaaataactgatgctttctaaaatcttctttattaaaaataaaagaggagggccttactaattacttagtatcagttgtggtatagtgggactctgtagggaccagaacaaagtaaacattgaagggagatggaagaaggaactctagccagagtcttgcatttctcagtcctaaacagggtaatggactggggctgaatcacatgaaggcaaggtcagatttttattattatgcacatctagcttgaaaattttctgttaagtcaattacagtgaaaaaccttacctggtattgaatgcttgcattgtatgtctggctattctgtgtttttattttaaaattataatatcaaaatatttgtgttataaaatattctaactatggaggccataaa

SEQ ID NO: 139236 - DNA, 1199 bp, Homo sapiens
ctacagtctctcttaatattgtatattatccaagaaatttcatttaatcagaacctgccagtctgataggtgaaaatggtatcttgtttttatttgcatttaaaaaaaattatgatagtggtatgcttggtttttttgaaggtatcaaattttttaccttatgaaacatgagggcaaaggatgtgttacgtggaagatttaaaaaaaatttttaatgcatttttttgagacaaggtcttgctctattgtccaggctggagtgcagtggcacaatcacagttcactccagcctcaacatcctgcactaaagtgattttcccacctcacctctcaagtagctgggactacaggtacatgctaccatgcctggctaatttttttttttttgcaggcatggggtctcactgtattgcccaggttggtgtggaagtttaatgactaagaggtgtttgttataaagtttaatgtatgaaactttctattaaattcctgattttatttctgtaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtgtgagtatatttaatatatgattctttttagtggcaacagtaggttttcttatattttctttgaatctctgcaaaccatacttgctttcatttcacttggttacagtgagatttttctaacatattcactagtactttacatcaaagccaatactgtttttttaaaactagtcaccttggaggatatatacttattttacaggtgtgtgtggttttttaaataaactccttttaggaattgctgttgggacttgggatacttttttcactatacatactggtgacagataccctctcttgagctacatcggtttgtggggagtcaaaagtcctttggagctaggtttgacaaataaggtgggttaacacttgtttcctagaaagcacatggagagctagagtattggcgaattgaagaaatccccctttttttttaacacacttaagaaaggggactgcaggtatactcaagagagtaagtcgcaccagaaaccacttttgatccaca

SEQ ID NO: 139237 - DNA, 3184 bp, Homo sapiens
tattagcttccatggtggctataggccaggcaagagagttaagaaaaaataaatagccaggtatggtgactcaagcctgtaatctcggcactttaggaggccgaggcaggaggatcgcttgagtccaggagttcaagaccagcctgagcaaaatagtgagatcctgtctctattttttaaaaaagccttggggcaaacaggagtatggaggtttggatgctaatagaacagcagtgtcttactgcttggagttctcttgtttcttgtcctatcaccgtagcctttggatcacagcaatttttccatgactccatacttttcagttcttgaatattttttcctttattcctcttgtctctgtaaagacatcaactggagttggactgtaataccaggtatctccagaagatggcactatttaacagattttataaataatttgatgtgagtcactgtcatctgaagcttgttgccttttctttctttcttctttcttttttttccccatcaattctgtatgtttgaaatgctgggttttaagttagttagaataagggatgtctgtaatttccctaaattgagaagtaatatgcaaaggttgatatcagaagtcatatgctcaccttgcaacaccaaataatactggcccatttgtgatttttgaaagtaacactccataataaatggatgtatatatagaagcataacaaaaatagaagcacataaaagtgaaaagtctcataaacgccattgtcactactcatgtaattgctgttacaaatttgtttaaatgttgaataaaaatggtgtcataggcaacacagtgttccactacttggtgtttttaatagcattattctgtctcagtgtgctttggattatcaggtgctttttaatagttgcatggtattacattgtgtagatgaacttgattaatttaaatggttccctgttaatggacatgttggtttgtttttgtgaacaactgatacagtgaacatttattttttaaataaaaaaaagagagacagggtcttgctgtgtttctcgggctggccttgaactcctggggtcaagcgatcgtcttgcctctgcctccctgggattacaggcatgaagccaccgcacccggcccagtgaacactcttgaatgtatctttgtatacttgtcagtgtttttgtagcattgattcccagaagtgggattactggattaagtgacatgcatgtttgcaattttaacaggtattgctatgtcattttcaaaagaagctatgccaattaatactctcaccaacaagagtgcttatttcccctcagcatattatcaggcttaagttttgccagtatgggtgggagaacagtagaatcacattgttttagtgtttgtttctcagatagatataattttacaccttataaccttctcttctataaattgtctatttgtgttcattctccattttcctatgggttcttattgttggagcccaatatataaaagggggtatttgttacagaacctcttcagttttggttcatgtcatgcctgggtttttaccctttctacggatgttaaaaaaaattctctattttcttccagtccacttatggctttattttttacatttagattttaatccgtctggaatttatttttgtgtatgctgtgaggtagggaccatacttttattttttcccaaatgggttactagttggccaaacatcatttattgaataattcatcttttccctactgactcgaaataccatctttattgtatactaaatcctcatatagttctgggtctgtttctgggctctactttgttcatttactgtgctggtactgcaccgttgtaattgctgtggctttgtggtatggtatggcttgctctctgctagggcaagtcgaagctcttttgttcacctgctctttcacccaaattttctgtcctgaatccagcacagccaaattatggtcattgtcaccaccaactacagtgggtgttgagcatttcccattgaatctcctgtaagggttttattggattctgtgatagcagtaaaatgggagcctaagaggtattccttaaaggactactaatcagacctggtttcccagatgatgctgaagatgacggggcctgggctagacttttgagggacatatccttggggttgggtgtgatatagaccagcccttacaatttgcttgactcatgggaatcgtacagggccagaaccagacacctgtcatgctaataacttccctcacaattcagaaatcactgtgattgaagatgggtggctgttataatactacccacttaaaaatggatgtaacccattttttaggactcttaaaaacatcaaatcagtaatggccgattaggactttttaatttttactaatctctacttgaaagttttctagtcattcatttcaggaaacctaattcttataattcatatcatttagaatatcataatgctatggatattagctagctaacttctcaaatcttctagttctcatttaatttgaagtttgtgtgtgtacataaggatatacatatacatatgtgtgtgtagatatatatatatatagttttttttttttttaactagaatgaccagtcaacaggggacataaaagtaattggtggagatgatctctcaactttaactggaaaggtatgtatcttgaaagggaagaaaaaaaagcacttcataccgagtcaattagtaacagtgtgctttcaatcaatcactaagagataatttacatagtataactaaatgggttatttaacccttggaagcagtctaggttaattatcgttccctaggtcatgtagtaaaaagacagtagaatccaacattaaccttaaatgtccatattgtcaagtactgctgtctgcctctgtgggactctaatttgggatccttcaaaaaacattgatgggggaaaagatagcctttaaaaaaaaaaaaaaaacaaacctatgtgagtctatgtgaggtagactcacatagtttcctaaaagatagcaaagcagtattatgtagtggctgaaagtgtgagttccggagcctgacaactgattcaaagcatggcttagtacttcctaactctgaccttgggcaagttacttaacctctctgtgtcccatatgtgatt

SEQ ID NO: 139238 - DNA, 1112 bp, Homo sapiens
tatttatttatttttgtgatggagtctcactctgctgcccaggctggagtgcagtagtacgatcttggctcactgcaacctccccttcccagttcaagtgattctcctgcctcagactcccaagtagctgggattacaggcgcacgccaccatgcctggctaatttttttatctttagtagagacagggtttcaccatgttgaccaggctgatctccaactcctgatctcaggtatccacctgcctcagcctcccaaagtaccgggattacgggtgtgagccaccctgcctggcctcattttgtcttttgggggtatttttgtgtgcagatatatatgtatataaatatttttccctcttttccccagttagtatttgagcagatgaactttggacccgaatacctgtattcaagtctctaataccacttcttggctattttcattttatcaaatggcctcttatcctcgtttttctcatttattaagtagagatgtaactacttgatataattcaaaaactcaataatggcattcttttgttttttagactctagtgtctgtactcgttgtaccatgctgggattcatttgaacaattgcatggcttttttagtgtattattaaatttgcagtttacttagaatttactgggacctcatacaaatgggaaaaaaacataactgtgttactcatttgctgtgtgcctttggattgaccctattttttgtattcattttctccccatgtcctgagttccactttgaataaaaagtaatttttttcctgcctgtaaaataggctaccaataggctgcagttgtctatagtagctgcttcactgaggagagctcagcatgagagaaatagtatgaattgcttgccacaagttatgggctagccttacttcattctgtacttggacctgtttaggcttctaagagatcttacctccaacaataaactgctttgagacatgaaaaggtggaagctttacttggttataactttacttttaatacctagaacagtgagtcttcaaacttgtatttgcatgcccaatttataaaaagtttcctgagcatttacccctaatatatgcattttaaattata

SEQ ID NO: 139239 - DNA, 1091 bp, Homo sapiens
aatatatacatatatatcttatattttatgtatatatatatatatcttgcttagattttgtcttatgtaatatttggtacataaaaaataatatttataatttatagactattttccatgtgttattatgtgctaaagtattttgtatcttagcaccgagaggctaagcagtttcctagggttaccagctagtaaactaagggaaacctttacttcctttagctcagtggttctcaaaatgtggttccctagaccaaaagtattaatatcagacaagaacctaccgaatcaaaatatctgtgatgaggcccagcaagctatgctttaacaagtttccgagtgattctgatgcatgctaaggtttaggatcccttgtttttactcataagtcactttctcattaaggccttccctggccatcctatataaaatctcatgttttcacaccgtcaacttcgtattcctcctcaatacttttattttcctgatcacttatcactaacagcctctctctctctctctctctctctctatgtatatatatatatatatcacttatcactgtctaacagcctctctttatatatatataatctatagattatatatatatgcagcattgtgcaatcattatcacgctcaattttaaaacattttcattgccccacaaagaaacccaatccccttagccatcactccccatttccccttcccccagcacctagcaaactgatcatctacctacttgctgtctataagatttgcctattctggacattttgtataaatagaatcatacaatatgtggccttttgtatctggcttctctcacttaatgttttcaaggttcattcatgttgtggagtatatctgcactcatttcctttttattgccaaattgtatggatagacaggtgttcctcaactgtgtcctgataaacccatctgaagttgaaaatatcataagttgaaaatggatttactactttgataaatctatcctaaagtcagaaaaatctcatgttgaaccatcgtaagttggataccatctgaattacatttttgttatccattcactggttgacagacgt

SEQ ID NO: 139240 - DNA, 1320 bp, Homo sapiens
aagaatgacagtattgcagttatacatgggggttttggtactttatattgtgactctgaatttaaagctatgcaatgtcttcttttttgaaaggatataattgacactggcaaaacaatgcagactttgctttccttggtcaggcagtataatccaaagatggtcaaggtcgcaaggtatgtatgacattttgacacagaatattttcctcatttgaagggggattaagtgattgcttctttttaaggataaatgttttcaactgtcattttatcttcgaaaagtaatgtaatctcatataagacttaagatataatccttttaaataattttgtcatgtgttaataaagctcataattacagtcacttccttgcctaatattaacatttggtttttcagcatgctaattatatcagtttgtcctgaatagcatggcagaggattttgggcccccttgcaaaattaagaataaggattccaaagcgggtgaggaagtgataggaaggggtgggccctgaagatctggacctcctggaattgagtgatgaatgctgcatcttctttgtgtctgtagtgaaattttataatgcctgcttccttttttattaagtcggcctcacctcctcaccttacctatgctgttttacttttgcttttatagttctacctgtgtttatttctcattttcgtttcatctctcaacaactctggggtggcattattattcccacttttcagataaggttactgaggcatagggaattgtccaaaggtacagagctagtccgctatagagatgagatttgaacccagggaacctggctcacagtttatgcttttgctaccttaagtttttaatagagtgacatcaaacaaacatttaagaatatgtttttcttttccttttataatttcattaaaaacattaagtctctgatcagtctgcagtttttatgtaggggtcaggtaatgttctaacttctgctttttcctaagtgattaacaggtttttataagcccttttgaaaaaatcacggtatctgtcgagcatctttgaatcagagtaagccttctagtgagtcatatgtcagcagtttgactgtatgggcttttctaatatccagttcaagtgtttatcagtgagtttttcttttaaatagatttgggacaggtactatgagagtatataagtgatacgttataggacactaactagtatcctatgaaatggcaaaaactgcaatcacttttgcaccaaccaaatagaaactaatcagtgcacttgcttatttttctacatgctctttagggttttaaat

SEQ ID NO: 139241 - DNA, 1046 bp, Homo sapiens
tggacacatgggtagtcagggtgcaggtctcagaactgtccttcaggttccaggtgatcaaccaagtgccttgtctgtagtgtcaactcattgctgccccttcctagtaatccccataatttagctctccatttcatagtctttccttgggtgtgttaaaagtgaccatggtacactcagcacggatgaaatgaaacagtgtttagaaacgtcagtcttctcttttgtaatgccctgtagtctctctgtatgttatatgtcacattttgtaattaacagcttgctggtgaaaaggaccccacgaagtgttggatataagccagactgtaagtgaattactttttttgtcaatcatttaaccatctttaacctaaaagagttttatgtgaaatggcttataattgcttagagaatatttgtagagaggcacatttgccagtattagatttaaaagtgatgttttctttatctaaatgatgaattatgattctttttagttgttggatttgaaattccagacaagtttgttgtaggatatgcccttgactataatgaatacttcagggatttgaatgtaagtaattgcttctttttctcactcatttttcaaaacacgcataaaaatttaggaaagagaattgttttctccttccagcacctcataatttgaacagactgatggttcccattagtcacataaagctgtagtctagtacagacgtccttagaactggaacctggccaggctagggtgacacttcttgttggctgaaatagttgaacagctttaatatacaataattgttgcattattatttcagatgataaatgtggtcataagtaagaaataaatgatcgagtttagtcttttaattcactgtcctttgaatacctgcctcttactctggaggcagaagtcccatggatgtgtttatgaacatggttgaggaagatttaggaagactgcaacagtacactacctaaagcaggttttttactccatctttttttgccacgtacactggcctcccactttgatatgcttg

SEQ ID NO: 139242 - DNA, 1420 bp, Homo sapiens
atagaaaaaattagctggggtggtggcgggcgcctatagtctcagctactcgggaggctgaggcaggagaatggcgtgaacccgggaggcagagcttgcagtgagcagagatcgtgccactgcactccagtctgggtgacagagcaagactccgtctcaaaaaaaaaaacaaaaacaagaaacaaattaaactaatgtgatagactactgctttgttttcaaaagatacactccccaaaagttactgatctaaaatacagtagtactatctctgtttagtaagaaccctgacaactaatagtgttcttatatgtaaaatgctattcttgcctttcatttcagaatatactttttaaatgtgaatttctggatttttttttatagcatgtttgtgtcattagtgaaactggaaaagcaaaatacaaagcctaagatgagagttcaagttgagtttggaaacatctggagtcctattgacatcgccagtaaaattatcaatgttctagttctgtggccatctgcttagtagagctttttgcatgtatcttctaagaattttatctgttttgtactttagaaatgtcagttgctgcattcctaaactgtttatttgcactatgagcctatagactatcagttccctttgggcggattgttgtttaacttgtaaatgaaaaaattctcttaaaccacagcactattgagtgaaacattgaactcatatctgtaagaaataaagagaagatatattagttttttaattggtattttaatttttatatatgcaggaaagaatagaagtgattgaatattgttaattataccaccgtgtgttagaaaagtaagaagcagtcaattttcacatcaaagacagcatctaagaagttttgttctgtcctggaattattttagtagtgtttcagtaatgttgactgtattttccaacttgttcaaattattaccagtgaatctttgtcagcagttcccttttaaatgcaaatcaataaattcccaaaaatttaactgctttatgaattcaatttaaaaatccttaaaataagtcctgtctctttaaaaaaacctatgcatagttatcatttctctacaaattaacctagtttagttttctgttggttccattttccttgtttgttaagttttagtagctagtttaattgtaatctcaatgattatgtggtagaatgggttggcggagctacaaaaattcctagctacttcagagacattaaatttcagacacatggtacactttatattacattttactatgctaaaataacacggctttcttttggaattctgttcagtttttcagattgtaatctcagctacatctcaacagattgttctcagatatgtcctattaccttctttgtgtagatagtgctttattgactaa

SEQ ID NO: 139243 - DNA, 1046 bp, Homo sapiens
tatcttcagtccccacccacgaaatgctggggggtggggaggactggaaaaggagtaaggggagaggaagggtgagcagctgcaagaagtctttacacctctctgcggttcctggtaaacgcgctcatgtcctgggtatggaagggacttaagaattcaggaaagatcaaaataacgggcctcttccccactccctcgccctcccttccccgctgctggggggttagggaggctccgtggagctccagcactctagaaggatcgggtgaggcgcgaggccttgcgggcgggtgaacccaaggtggggtggaaggctccaacccgcccaatctgagcccgaggcctgctgagaagcatgggggccttgggatagttccagaatgaggatgtgcgtttctagctgctttgcgccctcctcccccaaaaatctgctaccacaattccaacccggcggcacgcccccaagactcctttgtcgccccaggggcgggacctgagctgtcgatttcaggagcccttcgtgacttcaaaagtcctgggcactgttgctcatgagtgctgcacaactgtcgccctctaaagccacctccatccctcactgggctggcctcctgagccttcggtgaggaaacggggttccgagttgcccgcctgagagcttaacagtctgactagaaaagggctaattcgctttctgtgcaaatctcttgagctaattatttaatctgaaacatggacaggtaaaggaccattggcgggcgtggggagggaggtgtggaatctttcccacactttttgtcaccttaaagaaaaaaaaaagacacccaaactcctctggtctgaatgggctgcctggaactgggcttcccggggccaggagtgggcccctagaagtttcccagtttggggtggggccggggttccgaagtctagagctgggagtcgggttcagcggcccgagacgctggctctcccagactcccttgcgccggggcagtgcgcgggggcggctcgggtccctcccgggccggcggggaccctcaggc

SEQ ID NO: 139244 - DNA, 1033 bp, Homo sapiens
gacatgcgattttttaaaaagggacttggtggctggcgtctttcccgactgtaacgtgggttacggcaggcagaaaaacatctggtgataattctgaaaaaagtgctgtggcgtttgggggggttgtaaagcacgttttgcgggcgggatgggggcaaatctgacatttaaagtgtttaacaaatgagtgcggccgggaaattctcaggaaacggactgggaaaaaaaaaacaacaactaacatggaggggcggggagagaaaactgagtaaggggcagtgaccgactgtcagcctcgctagggtcgggagcgactggttttgacagaatgtaaatgaacttttcctcttatttgcaagaagttagttatgtcttggaaagaaatgtgtgattaatttcacattgtctctcccgaattaaaactttaaaggttgtttagttttccccgtagggacttgacattgtggaagtttggctagaatgcgccgagagaaggtacatcgtgtgtttggggtgtgggggacgaaggcatatgcaaaattaaaagacaaaacgttgtagagtatgaacagaggaagaggcgtattctttggctcttaaatcatttagccaaacacattgcagttcagaagggggtggggctatggcaactcgaaagtatcgattctttgtctattgtatcagtgaatgaccctctcctgaagtgacaagacgcccctttgtaatctcttttcgtaagtaaatttcagtctaaggggaaatatgtaaactaggggatcgaggtggctttttaggggtgtaactcgttgtactatcactgggagagatgaaaggggttagggtgaaaggtataaatgaatttgattccaagagcaatctggaagggaccttcgcctttgacaccgatgctgtttcgaatgaacttttgtttttctaagtagtcaactaaggaaatgttaaattaggcatgactttaacttctgacatgatggctcgtatatttgtgtggaacaaaatgttgggagaaagttgt

SEQ ID NO: 139245 - DNA, 1047 bp, Homo sapiens
aaatttgcagggagaagaaacttaagtagttctcacaaggatgttttgcacagtcattaagactacagttcaaaccccagctttccacctattagccaccttgccttaatcaagtccctcaacctctcttcccatcactttccttctctgtaaaatggaggacaacaatagtacctcacttttaaggacactgtgaagattaaatgagattatgtatgtaaagcgtttagcacagtgccggacacataggaagctctcaatacataggagatgctatcattaaaacaggaagagtttgtcctaaatgaatatcaaatgtttcatctcttataagctaaaaactacttgcagcaattaaacaggatttctccacccctagtttctatccagcaaagtttcaaacatgtcagggtcttagttttagcctggggctcccaaacacaattgtgcagatgtttgtatataaggaaatatatctatatagaaacatacataaggaaatacacagtctccatacaagcctctctaagccctggagccacagggcacttcatccagcaaggcaattcaatcacaacaaagtcatttttatattcctttaaagttcgtaaaaacaaaatcctccttttccagccagatgaatgtattggtacctttgctttgccctgcccctgagccggagtagctgaatctgtgctgaatccagcctctaagagcaaccttggtcaagtgcatggacccccagggggtcctattatcccatttgtacttgagggtatatggggattgggccaggcatgggtttctcaggcacacatagcaggtagaaatgatgcttcagagcctcagaggggtctccacatgaaaccacctcactcatatttctgaaagaaatgctcaaatctgagatgggttgggtggctaacactggtaaccccagcaactcgggaggctgagttgggaggatcacttgagcctgggagttccagatcagcctgaacaacatagtgaggccccatctccaaaataaaaggaaaaacctcaaat

SEQ ID NO: 139246 - DNA, 1021 bp, Homo sapiens
gaagcaatctctccagcctgagggtctcaggcaggacttggcctggtgggtgactggggccaagtgggggatgactggcaggccgagggcatgaggaggacagaggaagaaaggggggaaaaaggtgagggggtgagagactagaaagtgaagggaacaggcacagaagggagagaagagggacgccagagatgtttggagtagggacagttgggagaacccatggcgctgacagctccgcatcttgataaagtcatttcctgtttatcagacatcattagggcattagagttctcataccaaagatttatccaagagtagacatttggcccctttgggtatcaatccttttggaactcagtttcatttttttgttgtttttatttgtttatttgtttgtttttactgtgaatataccttatttagtcatttttgtttacaagtgaaactctgggaattcaaaattaacttcgttacctatgagcttcttaaagacaccagaaaagtttcaaccttgtgtgccacattgttctgctgtgctttgtccaaatgaacttttgcgaggcagctgccatccagtttcaagtggattctcttgcccacaatttcacttggaaagaccaagtcctcaagatcgcatggtacgcagctatcagagtacagctcctgtgatgcttttgcttattttttgtatggctttttcaagttggcttaggcagaattctcctctgagcaataaagacaacatgcttctcactgaactttttctccaattcacatactagccagacttggattttctgggaagatttcagtcgagaaacaggaacaaagattatgatagctttctgactaccaccaacttcagtttccttggctgctgtgatattcagctccctgagctgagccttgaggtccacgttcatctttggctccagaagagcctgggagatgccgaacttgaacttgtctggcttcttgccgttgggcttcgtgatcctagtgttcaaactgaacgtgg

SEQ ID NO: 139247 - DNA, 2865 bp, Homo sapiens
ttaaagttttacagatttcacacattctgatgctattattactctttggcatctctcttctccaaagttcaattttgtgagcctagtgaccttactagtatctggttttgctgatctcattttggatttagtgattaaatctcaaatgctgatttttgattgcttagaggaatcttttttcttagtgcctcaaaaaacacctattttgagtctatacatttaagaaaggcactgatgtgtattgcctttaatggtccttttccgcagcagtgatatgacagatttgatcagaaattctcttgcttgagagatttttttttgtcctctgttgactacatagtttcaaatctctctttatttcatgatgatatataaattgcttttaattatattaaatttttatttttctgcatcagcttcaagtacattattttgtttccctttcctgtttgagccgcttatgccatttctcacagaggggaagaaatacgtagttgctttcattactcttattgcttctttgctgttggggtgtgtgaagtgagcattgattttagtgctgagaatgtaaacggacttacaggatgcttggattagtcatcacaggttcttatgactttgctaccacagttgatatatttctcctcaaacctgttgccctaaggaatatataaaatattgttgatatttctaggtggtgttatcaaggagaagaaattcctgccttgaccagatgtgtggagcatctacaaatgaatgaatagttatttacacacaaaccactgtgtacaaaagcgtccatggagctgtcagtgtctcgagtggtattatgaggcctcaggtgccttggggtacattgtcatgctataagggatgtatatcataaggtatggtggaagaggggccttatgtgaatgattgccacatactgtttctgttgctgctttttttccgattcctttttgtcattggatttgtttgttttgtcatgtggtgaatggtgttttagttattgtgttgctgccagaatcagaatccagttcttgttcttactgccttatagttattgtgttgccaccagaatcagaatccagttcttgttcatactgccttgtagtgagggcagtttaatatctacaaagaagcttttagaagctgaaaaagtcaatgtgattgtgcattctgcttttaagaagctgtttcagctatgaactgtgtatgtgctataagtgtgaggtaccataagttatttaatttttaaaagaggaaactcctgagtgagctgtttaagaaatctgagtgtgatctattgttacgttatttataactaggtaaaatgtctgtcgtgatagatttcttttaacgttcagatactgtggttgggttgtctatatttaatatgcagatttgcctgctggaatcataatccatttttaagtgaatgtaagaaatgaaaactactgcatttgtgtcttttgaaggcaaggatccttggattttaaaggaagagtatgtgctttgaaggcactcagagactagtaatagcatatggtttgaagggaaacccattctctttcaattacaagagagcatcacttagcgtgcagtacttctgttacagcatccgatgtgtcctttattttaaattgtaaccataacagccattaatggctttatttcttgtattgctctcatctgggaaaagtctctacttcttcaaacgtaacataaatctattatgaagcttgtcccctagtatgccattataaagaaaaaattcttcgatggtatgcagtgtatctattctgtttgtaaaagatcatgtcaaaatgttctgcctctataatgataatagatggttttgtctttcaggatatttatccacctactgtcttctttgccttaaagggacacttggccatcatttttaggctcgaacttaacactgttaagaaataactgaaatatgatggtatttacattaatttttgaaattcaatggtgggatagaattaggtcaggaaatggaagttgttccaatggtgtgagaactaggagacaagatgattcactttattatttaaaccaagcttcatttttagtttttgttgtttaaatggactggaaagttaagtttttgcagggattgttttgaaataaagagatatgctaactcacagatgaactttgttaagacccctttatttttatataaagtctaatatttgaaaagcgattgttataaagtaaaattctctcttcctattctaatatatatcatatatttcaggcttctatttgaaaacaggtataagagatgatatgatacaaccctatagataatgttttttgcttgattgacttatataatcactgtttcatgattactgcttttggaataataggaagttttgtgaaatgctggccttgtgtatatcttagaatgcaaatttaataaagtgtgtatacatgcataaaatttactagtgttttaaaagtctgtcctttgttcttaataataattattttctgcccctatatcccagtagtttattctctgtgtctaattgcaggtcaagtttgaataaaaggatatcagaaacacaaaagaacgaatagctatgttgaagttggggctgtttgccaaaacgaagtgaaacctctccacataatcaaattttcaagagtattttgtagaatttgacaacttagaaggttcttgccagggtcatacatctttcttcctcgttttcaatttggtttatcttgttaaaatttttacatattgataagcctctataaattatttttagaaaaagatgagggtagataaacaggcaaaagggtccgggcacagtggctcac

SEQ ID NO: 139248 - DNA, 1858 bp, Homo sapiens
gtggtattattaatgatgcatttgacagcagtgagcgtagagtaggagtagtgtggaatatactgtttccatttttacttttacttttctgaagcctatttgtagtctgtctccatctaaaaacaatccacaagcaatggaatgaaatgacattttaaagaaaagcagaagagtagagaagcaagggtgggggtgatatatttcactgagggtagtacagggcccagaaactttctaatgtaccataggttacttttaacactagaagtacattaacttggacattcagataaatgataatattaaagactcctaacatttcgactcagagcatgttagactggaatgggctttttcaaaggagctagtgaccaaacttaaactagaacccatgtttcctgattcataattccttctccaattcgatgcttttttccttttcaaaaataaaaagtgtctgtgtaaattctaaaactgcccaattacctctcctgatttgtctgtcactgattcctggaactacccttgcttcctcccaaatcttaactagttaatacctgctcatccttcagattatagcaaatatcatctctggggaaccttttctcattcctccgaattaggttaggttacccatgttatatattctcatagccccttgtatctttcctttatcacttttactgcaaattataattatatatttattagcatgattatttaaatgtctgtctcctgcacaatactgtaaattcaatgagggctgggaccacgtctgttttaaacaccattgtatttctaatatctagtgtgcttcctgcacttggcaggcactcagtaaatattagaataagtgaatgattgaattcagggcaaatataaagcatagagcttattactggattgatggaaaccaaagccagaaaggcagcttgatgccagactgtaaaggctctcagttccttgctgaagtatggagccagattcatgagtcaggccaggttgatggttggggaacagtgagcccccaggctggatagggaaggaatccctgggctgggtatagaggttcttgatgtccagatctggagttttactggaaggataggaacaggagccagttgtcaggataaagaggcaatagacaacgggtattgagaccacaagtgtagattattcattgtagaagcttaactggagaataactgaagggatcaaagaaagggactcttctagaaatagacctttgggttttgaaagcaagaagaaaggaaatagtgtaaggaattataaatggcatagaattggagggggaaatcatttaaaaaatgtgtttgaattgaaggccctttgggaatggggaagtgataactctaggggagttgaaagactttgttttagagtagaggaactatgaggcagtgtacttgatcgaacacctctgatagtccgagtatggttacctcaataagtaaccattcctcttgctccaagcctgatgggaaggtaaacataagaatagaaatttcttgagctgaagtgaagtgaaggaactccctcccgaaaaccatggcatgtcacgaggaacgtttattgtaggttaggcggtctggtgcctctaggggggacaatcaaatgatacaggacctcgaagagtcttactttggatttctgtggctttataatgtagtatattatgtagttcattgctgtggctttatgcttttttattatttacaagtgatttactgatttgtgagctcttgaaactgtgtcattgcatgttatgtttaccctgatagttgcatttgcttataattctttttgctttgtcttcagttcagatattttggatggc

SEQ ID NO: 139249 - DNA, 1042 bp, Homo sapiens
tttgttattactttatcattggactgttttaatgagttgctcatacttcatccttagtttttctagacagagggcattactttaagtcataagtactttttttttttttttttttttttgagacggagtcttgctctgtcacccaggctggagtgcagtggtgcaatctcagctcactgcaagctccgcctcccgggttcacgccattctcctgcctcagcctctccaagtagctgggactacaggcgcccgccaccacgcctggctaattttttatatttttagtagagacggggtttcgccgtggtctcgatctcctgacttcgtgatccgcccacctcggcctcccaaagtgctgggattacaagcatgagccaccgcgcccagccaagtcataagtacttttggttgtgtgattcaaatattgcctcaatatgtatattcagtggctggaattaatttgttcagttttgattcaaggattcctatgtccaatttgaattgtccagatccttttttactgttgtctggctttcggccattagtctaagtaaggctcattagcacttccatcagagcttaagctaggaaagaaagaagagataaactcaaattagaccagaacttgttgcttttagaagctctagtagaagatttaatagtagactgtgaaaattacttttgtgcagtgatgttgctgtgggttaaaaaatcatgtaagtcttacttgacatggatagaataacaatgagtgatttgtgacgtgaagtctctgcttccatgaccatgagtagttgtaccagattaattcaaacagaaactagattttagttaagtgaaaatgtctggttaaagatttaccaagttctgaatctaaattgcagtggaaactaaatgtaagtgtgctattttctgttaatgaacaaaattatatatatttatattttaataatagggaagacattctgaaataaaatgttcagggctttttttttctgctcctcaattagcttatttctcttaaggtaatcagcagtgttag

SEQ ID NO: 139250 - DNA, 1041 bp, Homo sapiens
gacactgacttcagcacttttcccaaatgaatgtgaagctacgtaaatttagagaaataaagactatgggccttagaaatatccattatcccacttatctaaaataaagaacaatatgagaagggaaagaaaaaaaaacaccaatgttattaatttttattatcaatgcagcaatgggggaagacaggctaataagtctagtatataatattttgtctatgattgatgattttcaaaaacactttaaaactgcaataaggaggttttgctttcacgatccaaatccattctaaaatctcatcatatgctatcactacaaatcttactagttaacaaaaaacaatttggaaagacaaggtgtatctttaaaataactgatgctttcccttagatcatcattttttaataacacaaagcagaaatgatttggaggccaaattatgttccttcacaataattacaagctggtcacaaactgtaagacacaattcatatcaacaggtcttagagagttctagtggtcataatataaacgactactatttattctataacgaaatgcaagtgaacttgtaatactataaaaccaaataacaattatcctgtttaagaggccctacactattaaaacttatttgaatactaatgtagtgagcagtataaaatagtgataaaatgctctaagtttctttttatttttttttgagacagagtttcgctcttgttgcccaggctggaatgcaatggcatgatctctgctcactgcaacttccgcctcccaggttcaagtgattcccctgcctcagcctcctgagtagctgggactacaggcacacaccaccatgcccagcgaatttttacaaccattaagggagactggagtataagataaatgtattttagtagagacggggtttcatcatgttggctaggatgatctcgatctcctgacctcgtgatcctcctgccttggccctccaaagtgctgggattacaggcgtgagccactgcgcccagccactggtgaactcttaataagat

SEQ ID NO: 139251 - DNA, 1088 bp, Homo sapiens
cttaccctctgtcctcctccctcccctctgccctctcccttcccctccctcctccgcccccttcctctccctttcccccctctgccctcctcttatcctctctgtcctcctgcttttccacctatccttttccctccctcttccctcctccctccatccttgttttccctccatccttctttccttcatccttttccttcattctgtcaccttccaccactacctcttcgtcctcctctcctgcctcaccatcatcctcccttcctcatcatcatcctccttccctcctcctctcctacttttctccgcccccagcccccgcccccgtccccaagcctccgccccttagcccccgcccccagctgccagtccccagcagctcagtcctgcagtgagagtcttgggagtccatagctaagcaccaggagctgagcactgcccgctgtgcctgcctgcaagtctgacatggctcaggagaaaatggagctggaccttgagcctgacacatcttatgggggaaccctgaggagatccagcagcgctcccctaatccatgggctcaggtgagcagggttggggaggatggagtacaggattcaggggctccttgcccccatgcaagcaatcttccttccttaaagtgcacgtttgagctcatttgggctcttcaacctgagggggtggcgacttgtttgcttgacagtgacttgggtcccaaggtggagtgaaagtttaatctccaactttgggcagtgtggaggaaacggtccccctctacctggggccatgttgtccctctgtaaaaggaactgcagaaagcttctggctcttctgacaggttgcttgccccgactaacttacaccagggaatgtcagatcgaagcccctggaactagatgtgcaacttgacacctgtctctcagagctgctatttctaagcttagtttaggaatcctggcattaacagatgtttactttaataaatcacaatttatctaataacttgtaattaagtggtatgttcacatcgtagtacgtgatttggatttgccctaatgttttcaggttctaaaactgcctgaaatgca

SEQ ID NO: 139252 - DNA, 1079 bp, Homo sapiens
gcacaccactatgcctggataatttttttattttatttaattaatttatttatttctgagacggagtctcgctctgttgcctaggctggagtgcagtggcatgatctcggctcactgcaaccttcgcctcccgagttcaagcaattctcctgtctcagcctcccgagtagctgggactacaggcacccaccaccacacctggctaacttttgtatttttagtagagacggggtttcaccatattggtccgactggtctagaactcctgacctcaggtgatccacccgcctcggcatcccaaagtgctgggattacaggcatgagccactacgcctggccatttttttaaatttttggagagatgacgtctccctgtgatgcccaggctggtcctgaaatcctggcctcaagtggtactcctgcctcaggctcccaaagtactggcattacaggcatgagccaccacgtgtggcccctaataaaaattgagcttgtattccaaaagatccgaatgcattcagtctgtagttccctgtttcccaaagctctaaacataaattagtgccatgcagaaacagtttgtatatttgctcaggctgccattgcaaagtatcacaaactgggcggcttaaacaacagaaatatattgtttcacatttcttagggctagaagtctgagataaaggtgtcagtagggttgattccttctgagaactgtgagggaggatctgctccaggcctctgcccttggcttgttgatggctatcttcatgttcacatagtgttctccgtgtacatgtgtttgtttctaagtttctccttttcatgaaggacagcggtcatattggattagggcccaccctaatgacctcatcctaatctgcttgcttctgaatatattctgtctctaaataaggtcacatcctgaggcactggggattaggacttcaacacaggaatttgaggggacacaattcaacccataacagtctgctcacagttttttgttatatagctttatatttaattcctgatttgttaaacaggatatgagtcattggcacccagtaacaacttaa

SEQ ID NO: 139253 - DNA, 1714 bp, Homo sapiens
gcctccccagttcaggggattctcctgcctcagcttcccaagtagctgggattacaggtgcttgccaccacacccggctaatttttgtatttttagtagagacggggttttgccatgttggccaggcttgtcttgaactcctgacctcgtgtgatccacctgccccggcctcccaaagtgctggcattacaggcatgagccaccatgcctagcccctgtccatcttttaaagcagctttttatcattgggggcaacttttctgactgccccagtcccatgtgattatcctccttctctgtactttttttttatcacactttcatcatccttcatttaggactgagcatattcttactattttatattttatatattctctcttcaaaagagagaagcaaagtaggaatgccatacttctgtctctttgtggccctagggccctgggatacaggtagactctttgtgcttctgttaacaaagtccactggctttacccatgcttcaaaatggcacatctgctattattatgtttgatgtgactggataaagtaggaggtatgtttgatagatagatttgctatggccagacattagtgatttaattaaatctctccagtgactgcccattgctataaattggatttcttctttatgatatcaacaaaattcaaattgactttgggttcttggtagagtgcctgcctatgtgctatgttgtatttgttcattgaggtccaaacaattgcttattgaatgaaagattctgttaggtgcatacctttaactgttctccatttttcttctttcaggtcttatcacaatggccatacttagaacatgagcaaggatttcaattgacttctgaagtaaatctgtcttgaaaatatgaatgtggactgccttttatctctatttcactccattaacatgcaacaaactattgaatgatttcaaataattgcaaatgtataatatatattttaaattataatttaatttgaaggactgcagaacattattttacagacagcaaggatgcttctgagtgacacctaggaaattatttgaagaaattctttttatatctatacctgttgtgtaagaaactttaaaacatttgttattttctcacctttttttctaattcactttgattgctaggggtcatgtatgcttcgaagttacaggactaaaagagcaaactgaccggcctaaaactaaaatgacatttattccctagctacaaacatcagcgttattatgttaattataccttgccctctatcattataaatggttgccatggtgtttctaaaaataagtgttttaccattaatgtgtagagggcaaacaaagcataaagtactaagggatcatgcttatcctagggtctcacagaagagaggacatatttaattaatcttgtgaattacagaacaggttgtggtccagacaccaagaatcataggggtttttttttaaaaaacctaatagaagtagggtgacctctctctttggtctaagagttctaaaggaaggtaggcatctgtttaattagttggttcaccctggctttacctctggttaatgctttgtgttaataggaaggaaaaatcactttatcttttcttccaagcccctccctgcctgacttacccagactgggattaccagataccaggtgatttatgtggagatgatttttcaccttta

SEQ ID NO: 139254 - DNA, 1058 bp, Homo sapiens
ctcctgccttagcctcccgagtagctgggactacaggcgcccaccaccacacgtggctaattttgtatttttagtagagatggggtttctgcatgttggtcaggctggtctcgaactcctgacatcaggtgatctgtccgcctcggcctcccaaagtgctgggattacaggcgtgagccaccatggcgccaggcttcaaccttgtttttgtttttgtctcagtctggtctcttcataattaaataataataataacaacaaacacttagaacattgcctggcctttagtaagtgttattcaagagctttacatacagtatattaattcattcagtctatataattattaaaaagtttataatctgttatgaattatacaaatattagatatctttactaagaaaatgttgataggcgctttcagctcagtcaaaaaaacaaaaacacatccgacactgttgttaattacattcatgctataaagtatggaaataaagtagaatgattatctgaagcagcctatgcattaagtgccttcctttttaccttcatgtttctgtgcctttgttgttcccttggtctgaatgctctcccctcaacacttaagtgtgtacccttcttttcttccaagaccacctcaaatatcaactcctggcctttcttttttttgagatagagtcttgctctatcacctaggctggagtgcagtggtgtgatcttggctcactgcagcctctgctcccgggttcaagtggttctcctgcctcagcctcacaagtagctgggattacaggcacccgccactatgcctggctaatttttgtatttttagtagagacgggggcttcaccatgttggccaggctagtctcaaactcctgacctcaagtgatccgcccgcttcggcctcgcaaagtgctgggattacaggtgtgagccaccgcgcccggccaactcctggcctttcttacaggtagaattattcatgtagtcttctgattctctagcaccatatataccatggtatccttataagtatctattataatagaggtagct

SEQ ID NO: 139255 - DNA, 1036 bp, Homo sapiens
ggttcatttattaataaattcacggtccttagcctgggaccatggaattctagagcagaactgtccaatagacctttttgcagtgaagtctattaagcatttgaaatttagctaatattactgagaaactaaatttttgactaaacttaaagtgtcacatggggctgttggctaccatattggacagcaagcgcaattctagaggctttgagattttataaacttttgaaactagatgcagaaaaggatgtgtatgtgtatttttctaggaagtgagtctgaagctttcatcagattctcaaaaccaagagaaaaataaagaactactttaggtctttggtaaaaaagaagttaacaggttctttggtaaaaaagaagttgaccgaggtaagtaagccctcttgtgaccactcctgtttctcctttctcatttttttctgtccttagctgtaggtggctccctcccaccccaacgatttcagagagaaacaagtcggaatctgagaagtgaggctccagataaactgtaaactgctggaagggggcgatggctgtggccctgggttgtgcaatccaggcatccttgaatcaaggctctgtgtttcaagaatatgatactgactgtgaagttttccgtcagcgcttcaggcagttccagtacagagaagcagctgggcctcatgaagcatttaacaaactctgggagctttgctgtcaatggctgaagccaaagatgcgctctaaggaacaaatcctggagctgctagtgttggagcaattcctaactatcctgcccacagagatagagacctgggtgagggagcactgcccagagaatagagaaagagttgtgtcactgatagaagacttacagagagaacttgagataccagagcagcaggtaagaaaagaatgtgggatctttgtgattggtccaaaggaagtagctgaggcagctgggactagaccacacatttgtctctatgtcattccccagcctcaagatttctccagagtcctcttcctttttctcttc

SEQ ID NO: 139256 - DNA, 1046 bp, Homo sapiens
tcatacaggggagagaccctatgaatgcactgtatgtaaaaagcgattcactcggcggtcacatcttatagggcaccagagaacccattctgaagaagaaacatataaatgtcttgagtgtgggaaaagtttttgtcatggatcaagtcttaaaagacatctgaaaactcatacaggtgaaaaacctcatagatgtcataattgtgggaaaagttttagtcgactgacagctcttactttgcaccagagaacgcatactgaagagagaccttttaaatgtaattattgtgggaaaagttttagacagagaccaagcctcgttattcatttaagaatccacacaggggagaagccatacaagtgtactcattgttctaaaagcttcagacagagagccggccttattatgcaccaggtcactcactttagaggacttatttaagaattgctaagggaaacaggtcttacacaaattgacactaactcaaaaaaaatcttaacctgcagcaggctgtttgtcttggaagcttttgtttgagcttataagaacatagacagcttttttttttactagttttaaaacccatcttccaaggtatatgaattctagagtatttatctactcctgtgattttcttagatttgatttcttctgtctgcacaactcttctttttttaattacaatgaaaaattttgtgttccaaggcaactgtatcataggtgtaaacataaagcatataaattatgacaatccttttagaggtagggtcaatatagtggataaacctgtctatcagacgtattgattatagcagtactatagttattctgctgtcattattaaagatgattatattcattcaaagctttagatgtgtcccatgtggcaagaaaggagacagtgaattttgtcaaacaataaaaatgtgtcaggaacacaaggatgaaggggatgtcatttgcctggtaagaactgggttatttccactgaaatttgttatgtttaaggaaattaagattttaagcttgaaattatacaagcaga

SEQ ID NO: 139257 - DNA, 1052 bp, Homo sapiens
cctgcactgtctcttctaccctctgagtgtatctccccattcctgatgccagcccttagaacatcagttaaccaaaggaagaagagatacagagccaggagagctgaaggcctgggggaggagaggaagtaaactgaaatcattccattaagggtgtgacttgagggtgaggacatgacagaacatgctttaaaatactattataatgatgagaagttgcagaaggaaggagggtgggagctggagtatgacctttcgtgtttgattagtctgaactctagaccaaaatggtttcatttaaattggcctgaagttgcctggaggcactgctgtttaatcagaagggccagtccctctttgaatttttgtctctgccaaagacagcccacataactagacagtggacaataggattccagggagaatatctagcctttaatatagccatggcattggaaagtggagaccccctcctgttttatttcttgaaggaggatgttggcgatatgcagagcaaagctctccacttttcttaatagcttacgtaggtgcgtaaacattgtaaactccctttcatagtgatgcctttgagttgtgtgttagaagtagatttaggctatagctaggtacttttataaaatcagattttaaaaagtggacatagtacatccagtctagtagatcataccatctactgtcatgtaatatggcaaactgtatcattgtcacttcagtagctctgtcaaaagtgctggactggaaggcaagagatccatgttcttaacctgagtctgttactaattacacacatgaccccaggcaagtcacttaaccttttatggtgtcagtttcctcatctgttaaatgaagggattagactagattatttccaggactccttccgaaaaagtacaggagagagttgtataactgaaaggcagaaagtggaataattgaggcttggaattcagggtgacttaaaaattactttaggctggacatggtggctcacacctgtaatcccagcactttgggaggctgaggtgggagga

SEQ ID NO: 139258 - DNA, 1066 bp, Homo sapiens
tccatctcactggtgagtttaccaatgcaggaacagtttgtgatgacagagatgacagaatgctaagttgaagaagaaagtgagttggttgaaaaatactgttggaattgatttatgcaaattttctgggttgtttcagagcaagttttccccaaacttatggagagcagatggaaaaaggaaaatagtttatctttcaacaagagaaatgatggccctgctaaatttagactctggctttaacttgtgacatctgggaaaatactcaaatctgttaatcatttagtttgtataaccacctagaagagcccaatgtccaggatagacctctaacatgggcttacaaatggcagatattaccaggctgatttaatttcctttaataaaagataaaaagtcttgtcaaggagaggaaagcaacatgcattggctttctggatgtcaacaaggttttccttcattcattgtgaagagcttgctaacaagctaggaagatttggactggactgcactgctcctcaggggaatgtccagataggctgcaggatgtatgtgcctaaaacaggtcagtgcagtggctcagcaccaagtcagggggacaccacaaatggagcctcccagcaagaagttttgtcactgctgtgtgaaggagcctggcttgtgaaaattcataacgtacaaggattctttttactgtttggaaagattcattgccagtccctttaaatagctaccaccctagagaatattaatcattcaactatttttttttatttataaatagtcaattcacatacagtttgtaagggttacttttcttgtggaaagttaggtacagctgccctaaatatctttatcggttaccttggctggggaaattaacagcatgtttattaaacttgtacattatactgtgttataacattataccattttccaaatattagtaaggtcgctaacattttggaaaaggattacaagtgacctttagagatagaacaggagtttttcagaaaggcctctaacaccactcccacatccccttcgaggacagttgatctgcttt

SEQ ID NO: 139259 - DNA, 1114 bp, Homo sapiens
ctttactcttgcttaaaagtgaaaatattgcttcggtggaagaatcttggttagaagaattaatgtagctcagacagtcaatatagctaattgtctttaccaaggacaatgcatttaaaaaataactactccttcctctgccccttactccatgctcaccatcaatgtgaagctagggtaacaggtgtgttggcaggtttggttgagcctgaacagaaaactggacctcttgagccacagtccttcagccataatggacgaagtattttttgcttcagttctttgcgcttgatcattagagctagcaggtctttccgaaactgcttgctttagttctacctgatcagtgaagatatagaatagaattaggttaaagagtggttaatttcttagagttttgatacttgctgtttagtgattgtactttatatattgttcattgtataatcaagaaattctttgtaaatgtttggtttgcaggctggttggaaggaaaatcatgcaacattcatgagcgaactaaaaaatcttcaggcttctggactgactactctcggtcaggctctaagatcctcatttgatttgttaaatctcaatagattaatatctggaatagacaattatggacaggtaaaaataatttgagtgagtacagctaatttattttggtggcttggggtaagaatttaaaattgggcatgattactaagttttctgctacttttcataacctccaaaaatgagattcttattaccttttaaatatatactttttaaaaatccctcttcttttggttcttgtatatggcttgataatagaatagctaaaattgtctaccatgagataatcagatgtttgagaatgatgtgaataaacggctgagaaatatcggaacaagacaattggaaagaaactttcagtgtccttaactcctctgcccctcccaatttgatgaaaaagctctaggataagaaggcagagtagcatttgctgttgctcccattgtcctttcctcctctaaagtctgtgctcacagtaaccagagtcactctccaggttgcagcacgcaagtcactagtgtcctatctgtgccaggattttgacttaagtgaa

SEQ ID NO: 139260 - DNA, 1098 bp, Homo sapiens
atacttttattactttacatggctctaatgctttttaaatgtattttaggggagaaatccattttttttagaaccatctattttaattaccatcacagatggaaacaagttaacaagtactgctggtgttcaagaagaggtgagattttattttttttttaattttgtttaaatggcagggaacatgcagctatttctgtgggaggcatttccagttaacagtaagtttggtcaaatcatccatcttggtaatccttgaaagactgcttaattttattgagttacatgaaagaaaaagtcaaccctttaattctttcttcatttttatatggtttgttatgatgaaccttttcacatttttgccttatcagctccatcttcctttgaattcccctctgcctggaagtgaactaaccaaagaaccttttcgttgggatcaaaggttatttgccctggtgttgcgtttgcctggagtggcttctaccgaaccagagcaactagggagcgtaccaactgatgaatctgccatcacacagatgtgtgaagtcacaggaggtattggcaatatttaatgtttctgaaggaaaaattcagagcatagagtatatttttcattaaatgccatatccagtctttacttgttttccttcaaagccttttaactctgttgcttaaggtcatcattggtatatttgctgccaatgtagttatgattatttcaagttatattttaggattttaaaatgcttatattatgaaattatatttgatcaaacttgtgctatttatttttccttctgggataggtcgctcctactgtgtgagaacacaaagaatgttgaatcaatgtttagaatctctagttcaaaaagttcagagtggtgtagttattaattttgaaaaaacaggaccagatccacttcctattggagaaggtatagtagataacttttttaaccctaaagtgttatataggagaatgagaagacattaaataaattactatagacacagtcttcactatccacgtgcatttgagtggttacaaacatacatccaaacaactaccacacattcactgcctatgtatatgtatca

SEQ ID NO: 139261 - DNA, 1042 bp, Homo sapiens
tttctctattttattcctttaactgccatggttatttttataaaacacatctatgtttctcttattaaaagtaaccttaatttcattggaatttaagaataaatagatctggattcatatattacatcaacttccctttttaactctagaaattctcagtatggggtttccctctggaaaaagaaaatctgaagacattacagttgcctattgcctcttaaatgtgtcctagacacagcatgaagttggggcactggtggtgagaggcggaatccaaaaaaattcagaaatgacttggcctcattttggatttcataatgtgaagtattcatgattttgaactggtaatataatctaaatcaagattaccaaaataatttcagaggttgatgtggtaacctttaagcgaagtttctagaggtgaaaaggcagaatcttaaatggtaccattggtgtcactgggaggagaaattggggtgtgttactgtttaccatggcagtaatggggcaaacaataaaatgcaatgtgaaatgatttgatgatttgggaaataagattgaacgcaatttacttgtttgaatttgctgttacttgctcttcttatcccactctcttctgatttttttttactttctgctccttacttctctgctattttcattgccactttttaatgttccatgtttggttttatgtgcagcaccttgacttctaagaaatgaatcatgtccctttgccccttataactgaactttgagtattttaagatttattctattcttactgttgtgtattttgtttccttatagccattaaagaaagcactaaggatgatgggagctccaaatctgatatcagataatttagattgtggacttagttacagtgttatctcttaccttaaaaaactcagccaacaggtagtattggtaaaaacaaacaaacaaaaatcctttgccctcagaagtgcatttccttattctttagtgtaattgtaatttttcaaattaaatgtgtatatatctctacactttatggatt

SEQ ID NO: 139262 - DNA, 1028 bp, Homo sapiens
ggtcaccagtgtttcttgagccatttcagatgtatgtaaaacacaaaatatgccaaatatatattgctataatacactcaagcagtattaatcaatatggtatcacaatgcctattaagaggctttttacaaattacttacttagtaatatctgttaaattaagcattatcttctaagaccttttttggatagtcaaatataagagataaatagtttaattttttcagaccttttttggatagtccaatattagagataaatagtttaattttttcagatataatgccagtcgatgtgatctgaattttagtactagtttacacgtataaatacagtcttaaacctttatgtctgagtctgaaatgaacctgttcacttagactagattttatagtaacaaaatgtgcttttaaatgtctatgaatgaaattcttattcatggtttttattctctccatgattttattataattttgacactagacaagaaaaaaaaatattatttgtctttcctgccccctatctgtttgctgtgatagtgcaaagaagcacaggaaaatgtttaattatccatttttctgtgatttgtaattgaaaattgttctgtggggttctgaaagtattatctttcttaagtagtaaaaatgacagtggtaatgtagatgtttttataacatactatgtactttcattttagaccaaactagagtcagaacgaatactagcatcagtggggaagaaacctccccaggaaattggaattaaagtgaaaaatcattctggaggtggcatgtccttgactcacaataaaaattttagaaaactattgaaagaaatcacaggggaaactgcacttagactgacagaattgaacaccaaagaatttgctggcttccaaattgggctcttaaacaaggtaaattgtgacataaatagtttgtatttgtttgaacttgtctgatacatttatgtctttcatattcctttagttttgaaataatggacaatcctattttggagttagtag

SEQ ID NO: 139263 - DNA, 1039 bp, Homo sapiens
gaagcagatgagtttgtagcagggccacaaaacaaagtgaaacgtccaggggaacccaacagtcctatgtcatctaagagaaggcggagtatgtccctgctgttgaggaaaccacaaacaccacctactgtaactaaccatgtgggcggaaagggaccaccctcagcctcgtggttcccatcttatccaaacctcataaaacccacccttgtacatacaggtatagagtagtggttgtgatttccttatggctcctagaggactaagacgctaaacaattttatttccctttttgtgttccttcctttgtgttcagtttgtgttcattaagtaagccattactaaatcatctatttggtaggtacaataaaccccacagggagcagagaccctgtttcaaggatctcaatctacatgaggtgaaaaaaattataattatatagtaattaacacacagtaattaacagtaatgaatacattgcttagcaagtaaatgccacagtaattaatggagaaatggaaagaggtgagcatgtctgctgcaaccttttggagtggctgcaagggtgaggaggataaagcaggtttccctggcagtaggagcaagtggactcagcaagactggatctgcacttgctctttgtgttatcaccacctatgcatgctctaatccggtgcagtctggtatctgcctcctcgaccccactgaaacattctcatcaaggtcactagtgtgtgcagcacattgccattccttctccacagcatttgacacagttgttcactccctcctccatgtgtacgttgggtgctcagacaccataagcttatagctttcttttccctctaatagcaactccctttcatcctctttttctggttttgccttttctttccacctctaaatatcatagggcctcaaaactcaatcctggtacctctcctgtccttcactgcgttctcttcctaggtgaccccatgcagtcttggggctctaaatttgacctctagaatataaattgctcctcaatttcagact

SEQ ID NO: 139264 - DNA, 1082 bp, Homo sapiens
aaagagaggaataggctctgccttgcttttttctcaaaccctggccctcactcatagttaaggctgtctccagaagtatttggatttatgttatctgaactcaactcattcatccttctacttttatcatagcctcaggtaggcttgggccctcaattgccactattggtacttgctctaagacatatctttccatgaggacaatctttatattcctatgtagattgtaagcttcgatttgtatcccacacagtgccttgaacatcatgagtactttaagtatcttttggttcataaaatttctctttattttcaggtttaaaagacgagtcctaattcagtaccttgagaaggtactagaaaaaataaattcccaccaccttcacaacaacattagtcacatcaacagcagatcatcatgttagtgcaaagaccagtgagaaaaaaatgacaagttttctgtgctgtaggatggaacaggatattgttgaagcctcctggaatgtttgagtcaagggaattgctttccagatgctaagaagcagcagtggggcttttgaattttatgattatctggcagtgaaagctgggcttttgccttaataattttttaaagtatgaattgttttgttttgttttcctcaattgaggaagctgatgttattaattcacaggctaaattcggtaaacaccactgcccctaccacgggtaatgagaggtcactcacttgaactttgccattccaggcattctcagagtggcgaggggccacctgcaagtggagcacaacttggtgctcttactgtgtccttcagaaagaataggtgtacagaaaggaaatggcaatcttatgtgtgctgaacaaagttttcaacaattcctagttgtgccttttaaaccatgcaatattcaggatagtttgaatcaaagaagtaagaagctgctatttgggtaacttatttctctgtgggaaggggcagggagagtcaccaaacaatctacctccaactctcttctcttttgtctagagacattacaaagtgcacttgaggctgcccccaacctctgacatttgttcttg

SEQ ID NO: 139265 - DNA, 3899 bp, Homo sapiens
caaaaaataataataaaagaaagccatgtgtggtggtgcgcatctgtagtgccagcacttggggggctgagatgagagggtcgcttgagtccaggagtttgaggctgcagtgagctatgattgtgctactgcactccagcctgggcaacagaatgagaccctatctctattttttttaaaaagaagaaatttgagagctatatgctgcttttccaggtttcttattttctttatataggaaaagagatacagtataattattatttacagtctgatttcatgtattaatacttgttaaaaaatataacccatagtaaattgataattcgttagaagcctacttattttcaagtagggttttataaaggtttatctaaaattgatgcttttttcttctttcaaggacatttgatacgttaaggaatcacccatccttttatgtatttaatcatcgtggtcgagtacttttccggccttcggatacagcaaattcttcaaaccaagatgcattgtcctctaacacatcattgaagttacgaaaactcgaatcactgcgtcgttaagatttttacaaattataataataggacaggacacagagctggaatattggagtttggggtataaaacactcctccctgcccccattagtatttatattgatctttcagacctactttagtaaaaaaaaccatggcccttgtttatatactgttaatccaatcattaatgcagtgtaagttatatgtgaaatgagtctttggtatttcatataggaattattttttttttcatttaaaacaaatccacatcttttgtaaaagccactgttttgaacacatttccttgaaaaatgttggtggtttttgtgattatttatttttttagatttcttttcttttgcactacaatttttggaatccttttggaaatactgtgtgactgctgtgttttgcagcatgaattatagtaaaatggtcttcaattcttaacaaatggacttccctgatgagaccaaaatggtgatttaacagtttttcttgtgtcccctaaaaagtggctctgcttcagaagtacttgccagtttttaatttatttgtgacttttcaccctaccctgctcccatataccttctaccatcagctgtcttgtttcatcatttctctgagattctgtgtgcagtgagcaatttttgtgtcagaaattctttgtcagaacaaatatatgtaacaggctcaacttactgtaaagctacttgtgttctcttcatttgtctgtaaaaatttccctaattgattatatagtgtaagaatagttgaagactagttgaagaccttttgtgatttcattatcatgcctatgcagaagaaaaatcattgaggaaaattgtcattagccagtttaactgattcaaactctgtttatttcatactaaactagtgaataagtgaaataaaggaaactcgtcattaatctaaagacagagttcaaaggaattgggccaaatatattctcagtatttggaactaatgtttttaaggtttttaggaaaatcaggtcatttaagaaattgttttgtagtttctggtttatagcagtcttcaagttttccatcttcactgtatgttgctgaaagtgaggatgaggatacagagttgatatttttagaaacagtaattttacttttaaggaaattggctagctctttgagctagagagctgtaggaagctcaacatttctttgtagagaacgttgctttttttggattgtacaggtataaaaacattgcttttgttgaattgtataggtgtaaaaagggaataactgtatgcaggtttgaaaaggaaatgtgctttaggcatgagtcataagatgccattgtacttgtaggcattttattttcctttagaaatggacatcagctcttctcttctgactggtaacacatagccccaaagcatgagattatttttcattgggtttttattgttgtttagttttggtttgttacgccagcccagtctgtctgcggaacactgactctgctctctaatgagaacaaagttagaaatctgccgataacctaaaataatttagaaatgaattaaaaatgtgaaatcgggttaaagtgatgatgataaaatagcatgcaagaaacaagctccttccatcagacttggctactgttttcttctggtacgatttggtttggaagagcctcttgtttccttctctttggggtatgtcttcgtttcttaatatgtttgtaacattattgagatataattcacataccttacaattcacttattttaagggtacaatttagtggtttttagtgtattcacaaagttgtgtaaccgtgaccacagtcaattttagaacatttcgttaccccaaaaagaaaccctgtacccttgagcagtcacctctcattttctcccagtgcccaccccatccccgagcccctggcaaccactaatctatttctctctctgtagatttgcttattctggtcatttcatataaatggaattctacaatattcggtcttttgggactggcttcccaaatatgattttctatatggagtgagaaaattcttctcatcttgagaactcttattgctgtgaaagggagtggttggtaaaatcaatagatttcaggcaagagggccagatacctaacaggtttttctccgtgaatcttatgctgagtagtttttcctcataaccaagcatttatgatatattactacttataatactgtggctagtctctagaatggatgttgaaatctttgcctcctcagtcgggaagagtcctgctaaaaatcaggctaaaaatcaggccaaaaatcaggccaaatgacttggcaaataattgacaaagtggttttcacgtgtgtctatctttgctagcagcttgtatacctcaggccaggtgagctccccaaatttcttttttcatttactccagtgagtttctgctgtctttttcaagtatgtaccataggacttaaaggtgatttggatgcgttgtaacactgctaaatatgctaagtacagaattttatctacagtactgtgagacagtcaattattgcctagggtagttcaaaaatatgatgtgagctagttaagcctttgcttgactgatttcagtgatattcagaagtgtgtaccaatcaaggctctttaaaatacggaacgactcacttaataaccagggaaccagccaaatactgtgcagccgcagaatatgcatatcaatgagttggaggtgattattctctgtaactccctaatgattgttttctaagcattgtggcttctcagtggcttgacagcatcttcctggttgtatgtggcctgtttacatgatgtattgaataatgttgtttgttgtgagcatcaatgcctgtaacaccaaactaaacacgtgtttttgggatatgtttccaatctttaaatgaccttgccctgtccaataaataaatgattgtctcaccctgtttttggtagtgttttttgggctttttttttttggacttttaatctcatttcttctgcttttctgtccccagaaaaatgtaagagctaattttatgactgtatttttctactgtgatgctgttttactgaattcaatggataatttaattgtacatgtaaaatcttactgcagttttatgtttttaatagtcaaaatagaatgtataatcttgatgatgtttataaatcatcaaatgccctttggggtgtaaaaatgggttcttgagcagcagtgtctaatgattccatcacaaatttgttataaagccaaactcccattgaaagtgtcactttatacttaataggaaatcgttatgattaaagcatcaaggaagcaaatataa

SEQ ID NO: 139266 - DNA, 1572 bp, Homo sapiens
aggctgaaacaggagaattgcttgaacccgggaggtggaggttgcagtgagccgagattgcaccattgcactccagcctggataacaagagggaaacttcgtctcaaaaacaaaaagcaaacaacaacaacaacaacaaaaaaaaaacaaaaacaataataccttaaaaattcttagttgctcttggaagcaggtaatatttgatcattgagttctgagtggctcagtaccattcagtactcagtgattttgcttatttgaacactagatttatttattgaagcatcagaggtatttttgcagccaatccacagaatttatagattgtattgtgtctgaatcccagtcatttcaagtgagcattgtctccctgatggtggccctgagaggactacctgttagaggcaatgaagaggtagagagaaaattgtaaatatttataataatgtttgtgttatttagtattatcaatctttatactcacagatagttcttcagacacttctggcctttgcagttacctgttacggtatagttcatattgcaggagagtttaaagacatggatgccacttcagaactgaaaaataagtaagtctttctcttttcataggcattgcatttcatagaggtttgctgtattcacataattttaaaaagtatgttttctgatacataaaagttggttttgtttctgcattttgattacacagtttgtatgaataatgaggtaaaaacattgaggcggtatttgatactgtaagaaaatggaagatgaatgccagattattcacagtagaatcaaaaaaatacgttgcttaaaattattggttggttgtatggatgaaaatagatatatagaaaaataatgcctcagaatttttaacctttctccttccattccttccttgctccctttcttcccccctcccttccccctttcactccttccatccctctcttcctaccatcctctttctatcctcttgtcccagcttagtctttggaagagtaagtggttttcggtttcccctctcacttgaacctagtatgtgagataagctctgctcccaggcccttttctactactggattaaaagtatatttgttattctgctttcttttttttctcctggactacttctaagctattttcatgagctatgtttgcttttatttttcatatttttactttcctaaaatcatcctttagctttgttcagttccatctctggactttacccaccttcttgatcctggacatgatgcccctttacaatattttcttagaaggagtcacagtgaacatttatgtgttagaggaaagtcatatcccccttttagttcattatgtacattttatttatttttatttctttctttctttatggagacagagtctctatcaaccaggctggagtgcagtggcatgattttggctcactgcaacctctgcctcctaagttcaagtgattctcctgcctcagcctcctgagtagctgggattaacaggcacctgccgccatgcccggctaatttttgtatttttagtagagacggggtttcaccatgt

SEQ ID NO: 139267 - DNA, 1396 bp, Homo sapiens
acccaccagggccccccccccccggctacgcccacccacccacccactggccccgcccctcggctacacccaccctcgtgcgggccccgcgcgtcttccccaccccgcccgtctgcctaccccgcccctcgcccccacacgttctctacgcaggcccccgtccctctgccccaccctgttctcgccactggccctgcccccatttgccggcgcccttcctcttcgcttccccgtagctcccgctttcgcctcttcgtttatgactccgttgggctccggccctcctagagaggcctccatagcgcaggttcgtgggttctcgcggacctttttccgtgtagctttctgcttcttcccggcattcctgtttccgttttctcacagccctctggcttttccaccactgagacactttgcgctcaggacttcagtgacgtcatctttctgcggcgcgcggacacccgccggtggaagaagaaacagctccgccgtccttcgcttcttttgctgggctgctgctccttcggcatcatggcgccgtcgctgtggaaggggctggtgggcatcggtctctttgccctagcccacgccgccttttccgctgcgcagcgtaagtgcctggggcacggggaccgcttcggtgtggaaccctaggggcggtgtgtgggcgcacttctaagggaccatcggaccgagtgtcagattaatggtcctttgagaccttacagtttggggtgactaagaaaatcagtgcaggagttcccagtggaaggttcggagtttgaatttggagagagtgtggcacctgaaattgcaggaaggttggaaggaggtgtctgggagagggttcagaataggagtctccaggaatccaggacaagtgatgtcagatccagcatggggcagatcaggcacagttgtgagattgaggactctggttgctcatggtcccacgacaaccaagtggacaacatcttgggcactcttgggctgtccaggcagagactgagtagttaagtgaccgattgcctcagggaggcactgtggtacaggagaaagagcactggactgggagtctaaaggactggttgttaaaaacttgcattaccgctacatctgtgtgacgttgggcaaaagatttgtgctacactgcgttatgaaattcagttttgggtcgctgtttgaaattgcgctgtgtttaggtgctagagatacagtgatgccctgagccagttcaaagtctaaaggaaaacaagtggatcaagaagtagttacaataaagtgatatgctaaaagtatataaggatgcatggaagcagggacagtcatattttgggggaactgggaggttaaggaaagtatcctagatccttgctgcttacagtgtgatcaacag

SEQ ID NO: 139268 - DNA, 1105 bp, Homo sapiens
gtagaaagcgcagtctgcctctgcttggttacactgagccgatgtttctttagccaaaggcagtgggctagtttagacggcctttcattcccggcagcgcctgtgggtgcgtgtgacctgggacagaggggcaaaggaacctggcagagcgagcttgggatgccgcggcccctttaagagcggcggcggcggcgcgcgctccgacggctacccccgggccccgcccctttcccgtgagccctcggggagtggtccgaccgcgggcggccgccggtgaggtaggggcgggaggcggggggagacatggctcggcgcggctggcggcgggcacccctccgccgtggcgtcggcagcagtccccgagcccgcaggctcatgcggcccctttggttgctcctcgcagtgggcgtctttgactgggcaggggcttcggacggcggcggcggagaggctagagccatggacgaggagatcgtgtccgagaagcaagccgaggagagccaccggcaggacagcgccaacctgctcatcttcatcctgctgctcaccctcaccattctcacaatctggctcttcaagcaccgccgggcccgcttcctgcacgaaaccggcctggctatgatttatggcaagttcctcaacccttgtcagccccttggcgctgcccctttctctgcccgccggctgcttcgcctcctctgctggccctgctcggcctacgttcggctccccttctaattccttccattttctgcctcgccttccccctaccccgcgtttctctgcctcaccccctttcctcttcagcctcgcgccccattttatctgcctctccacacctttttcgcttccgaccccaccccctttttcctccgcacccccagccccccaccctttccctgcctaccaagctcgggacccggggctgaggatggaaaacgagtgggcgcggtgtctggaattgggctgggggctgggggaggggagacaccattgcgatccatttctctggggtgtcagtttgtttaaggttcattgaaactgcagtagtatctctactgcccagaatctggcgttcttttggagccagagtcgacctttactc

SEQ ID NO: 139269 - DNA, 1188 bp, Homo sapiens
tgaccgattgtagaataaatggcttcgattcttgtgtctcagtctgctttctgaggtttattattattattattattattattttggtgacaaggcgagaaggggtaaatcaaagtgtgggctcagaggcattttgagctgtgctggggcctcaagaggagaaaagatacatattgccgactgtattaatctgtgcgggtattgctaaagagatgagggcggacaaacaattctttctgtgcagtacatgtgtgaagattatcttcatttggagcagttaaaccgatgagcttgttgaggtttgtctctcagacttgcagataggtagatgaagctttggcacaaaagacattgctccatgcaaacccccgccccctagtaaatccagacttctgtaatgtgcatctctcaaggatagcaaggaaaggtagttgtgtgcctcaggaagatgcatgaactcaggcttatttttcatttttaagagaatacagttctgagcctgcgtgtaaaatatctctgctcactaagattcctagtttttagacatattagatggtttttatatttaatatgttttgcatttcatttgcagtgcaccttaagccaaattggccagataagctatatatttctatataattttctgcataacagtgtgtgatttatttactatcctcaacaaacatttgttgataaaccttctatgtattatgctcagaaaatacaaagaggtataagatctttgccttcaagtcacttataggcaggtcatataaagaaaataatggcatcttaaatttggttaaatgccaaatgagtattataaagtaatgaactgatcagagatacttcttttatagagagagatagtatgatgtggtaattaaaggtacaaggctttagaccagaggtcagcaatttttttttttttctgtaaagggccaggtagtaatgattgttgatcttgtggatacgtagatctctgtcgctgttgcattttttttctttgatttttttttctttttataaagttttacaacataaaaactattcttagctctcgggccatacaaaaacagaccaagggctgtagtttgccaacccctgctttagaatcagacctagattcccgtcacactctgcccataggtatgtgtgatcttagacaagtcccttactctcttttac

SEQ ID NO: 139270 - DNA, 1023 bp, Homo sapiens
ttcctaaaatataataccttcaaaaaatccttctcgcctcctgtcagtactctcttaggttaggacctaaactcttattgcctgaatgcctacagtagccctgtatctagccttttagaccctctttagtctagaccagtctttctaaagtagaaatctgctatcaagcctctgccttctatgacttcattttacttttgggataaacttcaaattcccttccccaacagataagatcttttatgattcaactcctgccaatctttcaaacctcaactcttgtcactttataagccagccatactaaactacttgattcactggatgggctgtgttgtctccatccttgactgatatgtactactattcccctacgtggaatatacccatttcttctagtttgttacctgcccaggtgacatctctggaaagacttccctaatgtcttactcccccagggttgcatagttgtctcttttctgtttttataataccttgtatacatatatatatatagcattatgattgtttattcagtctgttttcaccaactggaccgagttttccttgacattatgattgtttattcagtctgttttcaccaactggaccgagttttccttgaaggagggaccttgttttcatctctgaaccctggaggcctacctagcatagtacactcattcacgtattaaaagaatggctggctagtcagaatgaaaggcaataggaaggtaaaatgcagctagtagtggtatactatgcatggagttaaggaaagttccagaagtttgggttttatttgtagttgaggtatgtccatacaatgaaatatcgtttggtcgtaaaagtaaatgaggttctgatgcatgctacaacatagataaaccttgaaaatatgctaagtgaaagaagtcagacacaaaaggccatatattgtaggagttcatttatatgaaatgtctagaaaagacaggtccataaagaaagaaagtagatgagtggttgccaggggctgtggat

SEQ ID NO: 139271 - DNA, 1050 bp, Homo sapiens
aaacacatttctaacacgattgcactgtcgagttgggacacattggagcatattctgtctacagatgatttgaagatattttctccttttgttaccttcctcattacttatttaaatattgatctagaaatgcagtgatctgtgctgttgtcctagggaatgtttttctctcctgtttcactggattatatgaagattgggctgtttgttgtatgaatttagtaatattttaaaacataactgcatttcatctaaaaatcagttctgagctacagggaactaccgtaagagattttctcttatccatagttatgcgtggggtacaaaagaagtggtctctgtcggcaagaagagcttatgttgttcttttttccaggtcttttggtgggccttgtgcttcggtatggcattcatgttccgagtgatgtaaataatgtgaccctgagctgtgaagtgcagtcaagtccaactaccttactggtaaatgttagtggaaaattttatgagtatatgctgaaaggagagattagttcacatgaactcaataatgttcaagataatgaaatgcttagaaaggtaagttcttaaaggaaatctttgaatcttttttgtgtctaactagcagcaaaatgatccaggagaaaataagtaatggatttttaatgatatttaaaataatgagtctttttcaatggagtaaaacctcaattaacaaatgtaataatgtaaggaaatggatatgtctgtacaactcattttctgattgaggttaagtagtataactctttttgtttctctctggattgtttacagcttgttgtgataaatggagactgggattgagttaagcagaatttataagcgtttctttccatttgcagatggtccttatagttttctttttctttttctttctttattttattttttctgagatggagtctcactctgtcacccaggtagagtgcagtggcatgatcttggctcactgcagcctctgtctcctgggttcaagcaattctcctgcctcagcctcccgtgtagctggga

SEQ ID NO: 139272 - DNA, 1011 bp, Homo sapiens
tctgtgagagaatgaagccttataggaaacaatttgagtgagtcttttctcatttcacctaaggatgatagcgagctagtgccattttaaatttgtaagagataatacgttaactcattacaacctcagtgggattctggtggagaaggactgtatcttgagaggaacataacagagaaattgttagctctgtgttttaatagaattgaaaaaatgagttactgcccaaaagctgaagggaaagcagttgtgtgctcgctgtgggagtttactagctggaatgatcagtggtatcatgctcatcattcttcatttaccttttatgtgttttgaagtgggttagatgcagatagtctactttgtgttgaattttcttagtttgaggattatctactgtctgcattctgtgtaagcagctttgcatcaaaggggagggaacccctttttgaaggagttctgtttggcagttaacaggttaaggcaactcatcttgaaatttatgttggaggttgtttttgtttctgtctggtttttttttttcccaacttttattttaagttcaagggtacatgtgcaggatgtgcaggtttgttacataggtaaatatgtgccatggtggtttactgcacaggtcaacccatcacctagatattaagcacagcatccattagctattcttcctgaagcactgtttttttttttttttttttaacctattggagtagcagttattttattttattttattttattttttaaaataatgcttttaatccagtgagggtgaagtgaaattgactccctcatacatggctgcatgaggtagatctatatgtatattgatatattatgttagatacggtatatgtagttagagataaagtatacgttgcatagtattccactgaatggattaccgtgattagcctggggacctaaatccatattagtttaaaatatgttgtttacagtcatttatatttttatgaaagaagatgtacagagagacaa

SEQ ID NO: 139273 - DNA, 1059 bp, Homo sapiens
cacggtgaaaccccgtctctactaaaaattcaaaaaattagccgggcatggtggtgggcgcctgtagtcccagctactcgggaggctgaagcgggagaatggcatgaacccaggaggcggagcttgcagtgagccgagatggtgccactgcactccagcctgggcgacagtgcgagactccgtctcaaaaaaacaaaacaaaacaaaaaagtttccagctctaaaacttctatgatacttgtataaaacagatacgttattctttgtcaaggacttcttagtttggtatacttcagccttgtgctggaagaggcttcttttatggctttttataagtgaactgaggcataaagcagcagtaaaaagagttctgaaggtgatgccaagagtgatagtatctcttccccattacaagttccttgagggtagaaagtatatcttgttaatcattttgttgtagtgcctagttgtagaaatgactctagattctagcctgagattggtcgtaacttggcacaggcccttccactgtcagctaacaaatacttgttaaactagtataaagcagtgaagtgcctcaatttcttcatcatggaatgaatgctctatatcatagaagtggtagaggatcaaattcgtgtaaaatctcttggaaattatgtatttttataaatgtaaattgctacaattatggaagctgtctagctttgggtctcagattaatagaggtggcatgttatagatctgatctgttactcccgtctctatctatcctttactgcatggtttctggcaaggtgtgtgatacccgtgaaacaattggagtggctaagccgtaaggcttcctcactgaagggaaggcagctgactcctcagtaagatgctcattttaaaagtctccctattctggtggtaccttattctgagatttctgtgttagagaagctagagaacctttctttcatggttgccttgcttaaactgttattttttctagtcacacttttgtgttacaagatctcattactagccttaacagtcttacgtgacaaagttcac

SEQ ID NO: 139274 - DNA, 1010 bp, Homo sapiens
gaaactatcagttttagagattcattggtttgggggagctggaggatgagggatggttagaggtcctttctcatcattatgggtaggaagtgatgaaagtttgactaaggcagtagcagggacacaggaacattaaaaaaaactgacagtttggaggaagaggagaggaataattgaagatggggctttgaagaagggaagctgttaggggaaatgagggggcaacattcctggctttttctgcaggactagaaatgtcgtctccacatttgctcccttctgaaccacatattttgtgtgtatgcatgaagtttatatatatgagtgtctgttttaatatcttagtaatactcatgctttcaaattatgtaactttatttgctggactaatcttttacaatttcgtttcagttgtttgagcttctcaatttcttggcagagaatttcatcttctcctacatggggctgacactgttcaccttccagaaccatgtctttaacccaacatttgtagtaggagcatttgtatcctttattatgtgttttattttgaaaatatttttaattgagattttcatgtgggttttgagtatgtggttcataagaatacatttaaatatatacagttttcctctgagtaaaacaaataaggattccagctcttttttctagtctatttattttattatattctatttcaatttgtggttattgcacaaataatgttgacagattaaaatgacagacaagtgtcccactgttctgccaaccccaaaagataagtgttttccctttattactacagggaaggagaggttggatactggggagcagttagcagtctatgccacagggcagaaggcgaaagataaggaaacgttgaatgaggccactttctttctctttctctccctcccccaacccctctctctccctctctctttctctcatatatatacaaagagtcttataaaataaaaaccccaacctgggcaatgtagcaagacccc

SEQ ID NO: 139275 - DNA, 1054 bp, Homo sapiens
cctcacccttccaggtagctgagactataggtgcctgccaccacgcccagctcatttttttgtgtgtttttagtagagacggggtttccccatattggtcaggctggactcgaactcctgacctcaagtgatatacccgccttggcttcccaaagtgttgggattacaggcatgagccactgtgtctggcctaaattctgtgcttttagaaaagaagattatggaaacatagaacatgagcactggaaagggccttcagaattctctaaccctcatcatgtttttatacatgaagaaattcgggcccagagagagaaagggacttgcttaaactacttaatgtcaataagctgggactggaagcagattgcctaactgcccaactgctgactgcaccatattacaaataaagacacagtttatatttttggaaacttttagaagacgcctacttgctatgttagtttctcctcctagctggtcaggcttaccatggaatttccctacttgtttttattttgctagtgtttcaagaacatagtagcaactttgaagttgctagttattttcgagatccatgacgactcccaaatatagggatgttgatgtgatattttctaaggtgctattattacattgagagttaagtctttcaggttcagtacatgaattataccacattgattttttttcttttttttgagatggagtctcgctctgtcgccgagtctggagtgcagtggcacgatctcggctcactgcaacctctacctcccgggttcaagtgaacttcctgcctcagcctcctgagtagctgggattacaggcaggccccaccacgcctggctaatttttgtatttttagtagaaacggggtttcaccatgttggtcaggctggtctcgaactcctgatctcgtgatctgcctgcctcggcctcccaaagtgctgggattacaggcatgagccaccacacccggcccccacattgattttttaagtgagagtagattcgtaagttagcaagcagcctgagtaatagaggtgttcagaaa

SEQ ID NO: 139276 - DNA, 1036 bp, Homo sapiens
tggaacagttttatcccaaaactgttttgttcccagcccagtccatggaaaaattgtcttccacaaaaccggtccctggtgccaaaagagttggggaccactgctttaaatcatgccttttaaacattttatcattattaaaattaatttcttatttgaaaattcacctagcaaaaacagccatggagttctttcaggctctgatttatcagtaaatgattcaaaacttggtttatgttctattgaagcaaattggagacaaccgtgtaagaaatttgtccttgctttcaactttctgatgaaagccttgtatatttaagaaaaatcacttgacacttaatgattagaagctactacttaccatgttctgtttggtaatttttgcattcactgcttgcaagtacttcaaaattaaattattgtatggaaacaagaatgcaagcatatctggggtattaagactcccattagagaaagagagcctggctcttaaaattttttaaagattatgtcattacttttggctccattgtcagggttttggatataagccactctcatatctcttggggctttttcatccctctaatttagcaataattttttagtgagttttctgcataaaatgttttgtacattttctacataatatataaaacagttcaatgatcctaatgttgagaaagcgtagaataatagcttattcttctgtatattttatggaagtaaacaccaaggcttgtttgactcagtactgccctattaagtcctactcaatgaagacctgatcattttaatacctagtgccctgatataattaaatattcattattttagatttcagttcatttgtgtaggcaaatgatttgttataattgagctataacttgaatacaataaagtacacgaatcttaagtgtacagcttaatgaatttcaacctgtgtcaacaactgtgtgcctcccacccatacaaagatacaaatgaacattctctatccccctccacaaaggggtaaccatgattctgactttca

SEQ ID NO: 139277 - DNA, 1050 bp, Homo sapiens
atgatgaaaaccattttattactatgttctactggaaaatttaatttcctctctggccattaacattgtttactttctcccttatctcctgtagtgcccaatttacagtgatgttccttttggttttagtaaaatcagaaaagcaatgtgatgtagtggaaagggcacaagatttgaaattcagaccaatttgggctagcagattggtccccatttacctcattgtgtagctttaagcaggtcattgacctctctgagcctcagtttccatatctgtgaagtggagatgataaaatacccctttgctgtttcactgccatcatgtgaggaggaaatgagaccatagatgtgaaagccctttgctgtcctccgaagtggttactatactatgatggtgattattatcaaacgagttgctcttttaaatttgtaaagaaaggaccacagctcttccttaaccaccgcagctatctgaagcctctgctgacccacagcgggcctccgctgacaacaacactccctgcctgctgtggacccatcgccaggtgcctcaccagcccccaggcttacgaagtaagttggttttatccaaaactaaattcttcagtaagttaaatttatctgctctgtggatgagtcactggttttattttattttggtttgtttttttgcctttgaggtataaattccatgaaagggaatttaagcatattttgctcaaccagaaaatacactgaaacctataaatataattcacagcctttgaaacagcatttgaaaacagatatagaatcgtgcctcatcttactgtgggtgattttagtaaatagttctatttccctgctggctttcatttctttgcagtatgtgtcctgagctcagcactaaatgtgtatgctttcctccacaaatgagggttgtctcagttacattttgaggattttaaaacaattttgacatccctaaagtgcaacagatggtctattatttcacacctcccaacctttggatgtttgggaaagctatctgcctctgttccacatttctgg

SEQ ID NO: 139278 - DNA, 1189 bp, Homo sapiens
atttagaaccaggaacagttgaaagatgatgattctgatcttattctcaatgatggtgacatcagtttgacatatggagattctactgtgaacactgaaccggccacatccagcgccccaaggagatttatgggaaacagttctgaagatgccttggatcgggagcttgcatttggggaccatgaactggtcattcgaggaacacgcctggttcttccaatggatgattctgaacccccgctaaatttgttagataatacgagacatggtccagcctaagcttactaatactcacttagtgatttgtaaaatttgcacatgtgattgtgaagaaatttgtactacctaaaagtcccagtgcatgtctctgaatgtgtaagctatataaatgctatttatatggcatagaaagaatataaatatcctgtacacggcagattgtgaacaaactatattcctttaagttttcctggttgcactctgtagactggatctgttttaggaagttactttcacagtgatgttgtgtgttctgttagttttatgtctcagttaaagtgtaaaaagtgacggattttctctttcttaaacttacctgacacttaaccagagtaccagttctcgtgatgtgaattaatttttttgtgtgctaggggagggagagtgaggagggagtgttatttccttgggaacctagggaggagaggttcctttgttgggaaacttttgttgatagctgctgcctttgtcctgatcgttttctttcccttttctctggtggcctgttgtggtgcaacgagctgatggcatttgatcttgccccattcaggttggggagtgaagtgtgaggacccttttcccccgcttgctgtgaaagcacagattcattgactacagtacactgttgttcagaaaagaaggctgcaaatgacttctgagactttatgtcttttcttccagaccaagaccgtagaaggagtcacatctagccggcttagccaaagtacaggtgtatatagttcagggcacttgatttagatttggaggggctggggtgggcagagagcaagaggcgagtaaagagaatggtggtttcagagatctctcttcccaaatgtgtaaatattctataccagataagtttaaataagaaatttaattgctgcttaatttttgattatgtacttta

SEQ ID NO: 139279 - DNA, 1020 bp, Homo sapiens
catgacgtgtatgttttacatgatgtgtgcctcttcacgcagtaaatagtttcttgttaatgtatgtttgaggagtttgaacgtcagtgtcacttacccacaaagttattcaagttgtaaaaggttatacaataatttaacaactaccttttttattctgtcgggttactgacctcactttatgtaaatacttcgcatgacaaattcagtaactcgtctatttcagcatgcataagacttttcactagggaaactgataaagcttgagtcaactaaatctgccttcatactttatcaaggggaaccaagcctgctgtgcttacatcagcatctggaagactttcctctcctctaatctgtgtacacatctccaagcaaggaagaaaaaacaaactctgctcagacgcctatgaaacacctgaatgaactttgatgaagtacagtctgagttaccatcatgcacaagtagaactgctcttggacttgttttcctgttgtttgtggaacctacgcgtttgaatggcttgaacgttgcatcttttaaagttattttttaaggtttcttggcatttatcctagttgtccgtgtttggcaatgtgctgttaaagtaatagacttttaatctttatgtattttttgttttctctggagtacttggacagatgttatagtggtttcttttaggaaaatctgtcattaaaaaagttatagccttgcaaataaccactcacagtatttgagtcacagtttattttagtgagacgtaaagagtgctgacttcatttatttttctacctatatacctagtggaaaaggggaagactaatgttttcaaataaacaaacagaaacctaacagaacttaacttatgggttggcaaatttttggtgcttatgtgtaagggtggatgtatttgcttatggtcacaattggactctttaggaaatatgactcaaagctgtcaaattctattacattgatttgtagcctgttagcttagtaatggataatgttataaa

SEQ ID NO: 139280 - DNA, 1050 bp, Homo sapiens
actcctctcactacattagaattgttcatttattttatccatctcccccactagacagtaagccataggctcagacacccttgtctcaatcgtctgatttcccccagtgttaggtatactgctcagcaaaaagtagatacaggaacctaccaagaatgtgagggatgaacaaaggagcgaatgaatgaacaaaccaagatcaaacattccctttactggactagtgactgccactcattttcttctcttctgctttacccacagaagaggaaaaaatacctttttgagcattactctggtggctgtcacagaaggggtgaattctgctttcaaatgttttggcatttttttgactcacagctacacaacctgacaagatagccaactagctacttctcatgtttctgtggcatgcctcatgcactgctccatggagccgaccaaaaccgtattggctgggagatgtaaagtgccaaaaacggacctggcaaggagaaagaagaggcgatctgcttggagttgccattggtgggcacacaaacctgtgagtggctcgtgcgtgcttctccatggccatgcaagcttttgccctccctgcacttcacagggctgggagagaatggaaagtctatgtttaagatcagggtaagctcacgtctgtaatcctagcactttgggaggccaaggcgggtgtctcacctgaggtcaggagttcgagaccagcctggccaacatggtgaaacctcctctctactaaaaatacaaaaaaaaaaaaaaaaattagccaggtgtggtggtgggcacctgtaatcctagctgaggcaggagaattgcttgaacccgggaggaggaggttgcagtgagccgagatcccaccattgcactccagcttgggcaacaagagtgaaactcattctcaaaaaataaaataaaataaaataaaataaaaaacaggataagttgagaaagaagaaggtaaggagagggagaaagggagaattacaacaacagaattaaggccattgtcattttcccctttgatctgaatcg

SEQ ID NO: 139281 - DNA, 1030 bp, Homo sapiens
tgaggctccccccactattggacaccaaattctgcaaatgtttatggggctgttctcataagcccagcactacctaggttttgggaatccagagacaaatcagagagcaaggagctcagggtctagtggaggaaataagtcatataatcaaataaatgactcgacgatgtactaggtacaacaaaagaaatatgtataagatctcaaggtagcacagaagagggggtgctgaacacacttgggaggcccagtaaacagccaagggaggctaaattttgaagagccagaagggcccttccagaacaagaaacctgcatgaccaaatgcccagagacacaaagccacatgccagaggcttcatgccactgggtctttggggaataagaagacctgttattttcgagcctgaagtacaaggtagagagtagtggacattgagatttcagcaagggcagttcagggtgagctttgggaataagtgtttcggatttgagccacactaaaggtatgtaaacacaagaaaggagatgtctgtgttaacttgccttgataatgcccctcttgttacccaatcccactggtttcaacttcatcttctgggaacctatggtatttcaaagacactgcctgatccctttctagacaaattttatgcttttggaagtggcatttccccgctaagtactttatactgttttcttacaactttgcaaagcatctgccatatggtatttctcccaagtgagagattattgcctctttattggagggggggagctgaaatgaagtcatctgtccactgaagtgacagctgcaagcagagatgtactctctaggcagcaggcctgccgtcagagcccaacccggtgcgccttctccaagagcggctgtcccctcccagcctcctgtcgccgctttccctttcttcttgcttcctgttatataagagcatttttgcagagatgagctctgggcttgttctgaatattttaggtgtcaaacatcctgtttttctctgagtaatgtgacc

SEQ ID NO: 139282 - DNA, 1021 bp, Homo sapiens
caggcacaacagaactatttgaatgtctgctttaaagtaaagatctgctcatgtcgttgcacgaacagtagggagcaggaaagctgcatggagcaaatgctgggatgggacagaggagactcctgctgccagccacgagaaggttaggctgacctgatcagctattaggaatctttctccctgggtggaaggagccaaggtgcaggactggcattgcaaaatctggtgatagaaggccaaagagtgcttctgctcggtgacattaatagggtccaggagattttcttctgatttgccctcaagttcagaacaacctgtgggaagccagtgtaagaatgcttatactggataagcgttctctgtcctcttcatttagccacagtggcttgtttatactctgtgatgactcagggttcctcaattttctctttgagagagggacattgacctttgaaaataatgaaggaatctaagagaaggctcatccaggcacgatacagtaatggtccctcctttttggtgccccggtctctgtgcgctcacaagagggaatgtaacctttgccagcaccatacctgtcaggctttgccatttcatccctcaaaaggttgctgcgtttttgccttcaccttcaccctgcccacccctgcatgcagccacatggtcagtgtaggtacttagatttcagttagggtacatgctcagcaggtgacaagaattgcctttgttatgtctacttgctacagaattctccccaggttttaaaatatatatcttcaaatacctaaatgtattaaaccttaaagagtaaaaagcataggacaaacttttagaaatgctaaacctgaattttatccatttcatcaattatggtggtagtcggaagtccttccaaggccctcgggcttgaagcaagctcggtgatacaagctttcagcagcttccctctgctgctggagatggaatcttcatttctgggtctaaatcctgccatagctctcattcatagcctttacctata

SEQ ID NO: 139283 - DNA, 1052 bp, Homo sapiens
agggttgagggcaaacatttcagaggaaggttactttctgatgatggtacctgattaagaaaaggatacatcgacaggtacgggtgatttattttattctggcagattcctgtagtctactttggtgcttctcacactttaatgtgcagattctgatgcagcaggtctagagtagggcctgagatcctgcatttccaacaagcgccaggttataccactgctgatctgaggacctccctctctttgagtagcaaggggactctaaaagcaatcctaagaaaaatcagtcaggcagtgatggtgctaatgtttagaacattcacttttctctagcctgagaaagaaaaagagatacgaaccagggtattttgggttgaatcttcccagataaatctggatctactttgagttggagcagaggagatgaaaaatcaattattttcaatacagtatagcacatgggaaagataaatctaactctgattttaaaatttgttttaaattaagtgcttctggtaaaaaaaaagctagatatgctcaggaatcatgaaatgtagggattagagcttttaattttaggaaaatatggggctgttagcaaacttgtaaatcagaccacagaaaataggataattatcaaatccctggttatatgataaccttgtaagctataaaatgattttaaaaagttggaaagaaagaaatcaacagtttcaaatatatacagtcctatattgaaaagtataattaaaatgaaaaagcacaccaggaaaaatctgtggcacagatgacaagatacataatttctatatcatgcacagacctcatacagattgtaagaaaggtgcgcacaggcctagcacgtggtaggtgcttcctaactgttggctgaatgaattatccaattgatagatgggtaaaagacactcaagttatatcacaatgtaaagaaatgcatggaaaacactcagcctcactggtatgcaaagataagcatatttgaacgtcagcaaggcacacttttactaagttagcagaattacaaaaagaaa

SEQ ID NO: 139284 - DNA, 1463 bp, Homo sapiens
tattatttagtgccagagacttagtaggcatttgctagagatacaattaattgaatgaaaggcattatgtaaattacaaaccatagcattaccgtggtattacacaggactgtcttaggatccctgttcctctaatatccatattcctgaattgttggaggatatgcttgaatagaacaatcccttttccttcactgtagcatgacattatttcttcccggcctgttatcagcaagtttttcgaacagaaaagttgaaattatacagtgaacgctcctattcctaccacctagagtcagcaattaaacattttactatatttgctttatcaaatatccaccatttacccatcttaatttttggatgcatttcagagtacgctgaaggcatctgtacgctttacccctaaacacttcagctttatcattatgtggtttcaattttgactttcttagagctgctttcaaatttgttgagatcctgacatttattttggtggtggctaagaagacgtagtaactcaaatgtgcaatatgctcagttttcagaccctgggagtttctctttgtttgtaactaccagcaagtatacggacacatacatatcgctgtcccttccccgcttcgttatatggtcacattatttgtattgttgaaatttggaaagccagcctaggaaatgcagttgaggggcttgtggatatgaatgaaatcaaagaattggggttgagaatagtagggcaaaaggttagagttagctactataaagggaggatagagttgggtataaggagtggggaagagattcagatcaggaagttatcagcatgataccactttcatatatgaagtctagagagggtttggtggctgttcatatgacctaaaggtcatggattgaataaacactaagagtgcaaatagtccttccagtctagtggttttcatattgtattccatggaaccctagaatttatagacatgtctcagaggttttaccaacatttgaattatactttcgcaagtatattgaactatttttaaaaacactaataagaaaacccaacaaaaacacttgactgtgttttatagaaaattttatcatcctggagaacacatactgattgactttattttattttattttatttattatttttttgagacagagtctcactctctcgcccaggctggagtgcaaaggcgtgatctcggctcactgcaacctctgtctcccaggttgaagcgattctcctgcctcagcttcctgagtagctggaattacaggcgcttaccactacgcctggctaatttttgtatttttagtagagacggggttttgccatgttggccaggctggtcgtgaactcctgacttgaggtgaccccacccgccttggtcccccaaagtgctgggattacaggcgtgagccaccgcgcccggccctgattgactttaacataa

SEQ ID NO: 139285 - DNA, 1108 bp, Homo sapiens
cttcttcaagttgttactaaatctccagccctttaaacaacagaaataaaaagtgttccttattttaatttttccgaaatgaaagtcctataactaaccttggcttaattttttcttttgttgagggctttccaagttattttctttgtgaggaatggaggctaaaccatgtcagttgcttgaagcaactaaaaataccccgtacaaatatgcagaggagtatgcttttgatttttagatcaaaacgaagaagcaagattttatggagcttgcttattatacatttattatactgagctacttgtgccttttcaaataattaaatattaactaaatacaagaggattaaatagctagactttaaataaaactaaaatagccatattagtattttctaaattctgtatcattgaaagtttaggctgatatgaaagagagggaattcctatcatggggattgccagtcttttcacaaagacctgccactagattttgtagtatatgataaatgtgtgtgtgtttattgtgaaaattgtgtgagtcatatgaaaaattaagtctacttgaaaaatcaaaagacattacctacttgggtacaaagcctgatttatatatatatttctttaatgaccatattatgttatgttaaagtttgtatagtacttggacatatattatttaatttcattcctaaaacaattcaatagggaaagcaagacagatattaatattcccatttcatagatgaggaagaaaaaataacttggcttgtaagcaattcagcagagtcagagattgcatttgagatttttgattctaagtctagtgtgctttccttgggttacaacacaataaagtcaaaaacatttactgttattttcattaattgaaagcttaaaatcaatttaaaattctaacagtataaaatttaacagtataaaaatattgttaatttaattttatgacgttaatttttaaattgatttttgaatttgctaaaagtgttttaaaatcagtatcctgtttcacaattcctgaattaatctcttctctgtacatttcctgttccagtatgataatttatataggctttagcatttacttatgg

SEQ ID NO: 139286 - DNA, 1051 bp, Homo sapiens
agaatacttttcactatgtattctttcatacttcttcaaaaatacatctttggaaataaacccatgcaaaaaaaagaatgttcacagcagtattatagtggctaaaaagtggaaataacccaaatgtccattacctgatgaatggttgaacaatatgtggtgtatctgtacaatggactattattcagccataaagagaactgaagtactgatgcatgctatagcatgaatgaacctcgaaaacattatactaagggaaagaaatctgccacaaaaagctgcatattgtgtgattccatttttatgaaagcattatgctaagtgaaagaaatcagccacagaaggccatatattgtatgattccattgccagaagtggcacatccataaagacagaaagtaggttagtggttcccacggggtgggggtggggtatgcagagtgatggctaagaggtccaggatttctttgggggtgatgaaaatgcagaatcagatggtggtaatgattgatatacattatgaatatactaaaagctgctgaattgtacactttataaaggtgaattttatgatatataaattattttaaattttacttagagatggggatctcactatgttgcccaggctagtcttgaactcctggcttcaagcaatccttctgccttggcctcccaaagcacaggcatgtaaattatatctcaataaataaaataacatagcaaaacaacttgaagtcatgaacatggaaacttaaagaatcactgtgaacatataaaacaaaagttttcacctaagaaatgtttttattctaaaatattttacatattatctctataatgacaaaggacttcatgttctttagctaccttcactcacactcacctggaattatttcattttataagtgaagattgttaacccaaatgaagccctgattgataaaattttgggtaaaataactaaagaaagaatgtgtgattatctggaattgagatgttgtagctgcaggccttgcccaggctgtgccagtaggagaggaggtacgga

SEQ ID NO: 139287 - DNA, 2005 bp, Homo sapiens
ttcactttatgtactttcagtcctctggaaatctggatttcccctgctatcaaaatagacaatgctattgcctaacaaaatatagacttcctgagtgacatccaggtcacggcttgatctctttcctcctgctgtgttcatgcttccacttccgtgcaccatgttaggttcagatgatctactgaccaaaccccagagaaccactcatgagtcttttcaacctttaccttgaattctagggctatcttctatttggggtttgaaaacaccagtgcataataaagtaatgtattaattatagttttttggtaaataaagatagatcgtatgttactagccttgatgtttcacacaatgaagcagagctcatgaattattataacatccctgatcaaggcagttgatctcagttatcagcattaagaataaaggtatggatggaagcttatttgatttgttcttctttcctattatggatattaaccagctgggtaaattatagaatagggtcatggaatgtttagccctcaagcatttatcagaggcttaaaatgttcataaaaggtgggcttggtgaatgccaggacttagcatggttgaaagggtgttttgagtcatggtacatggcaatatggaaataaaacagatatgtcacaagtaggtggtagaaataaactggaagagaattttaacatctaaaatgtgacaaagatttatccttaccagcttctcagtttcctgaaacatttattttcctttgattttagattctgtatttatgttatatatctctttctaaaacattttcttgtttctgttttctttacttcttttacttttttgccacttctgttttttgaaaaatatcatcctaggcatgctctgaaagtcatttgttcggtgttttcctgatagtgatttctggttataggcccataaagtatctgtaggatgtggttaggatagttcctacctcttggtaaaagtctagtagtaacacaggaagggcacagactttggggacaagagacatttaaaactgttactgatcatgacattaccaaaaatcaaaagacaggggccatggctcatgcttcgtaatctctctgtgaatattataaggaaaattctaagccctggtcaactgtgaaatgaacaggtcttcagtggagttaattagcattttccaggtgctttgctgtttacagtgtcctttatttcatgtatcttctcatttgttacaggtcttctttcataccttttccttttctctgagattcagagaccctttggggaggctgaatttcaggtttgttttcattaggaccttacatgaccaaatcccccctcttggggttccaggggtgctccttcattttactctctgatgggtatgccatgaattgtgacatttaagcagtgactttgcaaaattggacgtgtcagtaggaaaaagtactcttcccaccttaaagattgacaggaacatgagatggctgaagctgttctgagcttttttctggcaagagtacataggacaagaaatactctggagagctcaacattgaatcacatcatatcatagtgcatgactagttgccttaatcttgcagttggactcactcaggagaaattgttggcagagggattaagtagcctgacaaaattatattgagaaaaaaacttgcagtctattaatttattagtagtagatatgagggaaagaagagtcatgtaaaaaaaaaaaaaaacaactggacatgaaaccacggagaaatccacaaagactccattacagtttgttatcagcctcttgcccctggccatgactaatggccagtaattgtctgaataagtttttaaccatttggaaatttcttcaggaaaagaaaaatctagtaaagggagaagggtgaccacaagtcaagctgtgaatgaggaagtcctgaaatgtgggctaagtgggtcactgaatttgccgtgtttgattcttcggttgcaccac

SEQ ID NO: 139288 - DNA, 1033 bp, Homo sapiens
gtttgatcctcccagtggtgtttctgaggtagagaggctaggattagattgcagtgtgagaaatcccacaaacgtgattctactgtaatcttactgttctctctcgctccttgataactgggatcccattaaagggggttcattattgacatctcagaagaaactcattgtgaagtctaaaataaagtgccattcttccctacaccagctctgcctcccatattccccattattttcccagtcacccagagtcacaacctcagagagatccttggctccttccccttctttcagttcttgtagccctgtcacagtgtcccttatatctagtttttcctttccatgcccattgcccctgcctctcattctttcagtctttccttgcatctcagtggacaattgcattaccctgtgctgtcttccctgcctcctctcttctctgagatctgctcttcttatcactgcttgcatgactccatctcattctccccttgcaccagttgcagaaagatcctccgtgtgtggctttccctcctctctagctttcggtcctactacttccttatcttgtgcttctgtcacaccccaaccccccccagctgcatcctgcttcttgaacacgtcctgtgtttttctcataccttaggtgacatggtaccattttcttggaacactccctcccccttgtctgcatgccaaagtcttaatcattcttcagggaccaggtcaaatgccgtgacatccatcaagtcttttctcatctccaaaccagatgtgatctctccctgtgataaatgtcagtaacactttatacctttcttgtaatacttgtaaggctctgccttgcatagtagtcatttgcatatttatcttgttacacttgaaagtaaggactgtattttattctttgtgaccagtaaaataccttgcaccacatagtagggcatctgtccaataaatgcttgtcatatacaataaagcaatggctggggcggcattatctacaggttaacccaataataggtcataatgt

SEQ ID NO: 139289 - DNA, 1092 bp, Homo sapiens
atttggtaccttttgggtggcaggattctataggaaatgccttggcaaagggagctgcagagtgccttagtaatgcttgggattgcaggcgtgttgtctagggccacagccggggaggggaccagggagggaagaggggttgttcatacggagggagtggaagggattcttggaataattttttccagactctattttaagattataatttttaagacagcaaatatcccaaatggtaatactggttacacttctatgagcatattgattctcacttgcttgactcaagggagggtttgattttggtcacaaagccacccgtgactatgacagataattcaaggttgccaaacttgcctgtgccaattgacaaagccatttatataagtcctctcttgctatattgctctggcctcaaaaggcagtaaactctcttggacaaaactctttaggatctattcagggatttaacacttttctgctaaattgcaagtaaatttaaacattttaaacaaattaacaaggattgcttaggtacctggtgtggtacagaatgagctgtcagtttctattctgatgaatagaattttatagataggaggaacgggaggcctccagaggatactaccctccctaaaaagagacggaggaagagctgaaagcgggcagagaggcttcttgatgacaacgtggtgggcttagagaagctgctgcctgcaggcggggcccctgctttcctgcacccctttgagcctctgccccacactcttcctttgtataaaacaactgcttcttgcctgcctgccccatcacacccctccactccatcgggtcactgctcaatggcacaatagcactgctcagccatacctcccagcatcctgtcccctatctggtgacttggccaacacaggctctgatccacttgccccgctccgcatcttttgtgaatcagcacagttgatatatctgagcaggggcttctaccatctccccagggaatcactagccatcggccatctggccccgcggggtgcttttgttcctggaatcatagtgaagtatctgttgtcttggtgcctggtagtcagc

SEQ ID NO: 139290 - DNA, 1608 bp, Homo sapiens
ttgacaagttctgtgccaacacctgtgtggaatgccgcaagcccatcggtgcggactccaaggtaacgggcatccccatgtgccaatgggaagggctgggttttggagtgtcctttgcccacaaccatggcagcagcagctggctgttaggatttcccagcatcactgcagccaccttgaggcctcaaggaagcctcctccactccccaggccacagtggcccgagctgtttaatgtggggcttgactggatgggcgccagcgcccttgccagctcttttgattgcattctaaatatttcaagaattgtgagatttttatcctcacctcagcgtccctcctataagaatagtcactgtggggcagtcccaggtgtaagggactgtgtcatctcagtggtcagtcccagggaaatcagccttatgggagggctcctgccaccacccccagcacccctcatggtggcccaccctgtctgcttggtttccaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctaacgttgctctgagctgctttgagatcttagcatatatatgtacacatatacatacacgtatatatgcgtacacatatatgctcgcacacacgcacacactcggagactaaagaacactggcgagaacagcctgtggcaacagaatgaagtgaacagtatgtagcgctttctcatttgggcgtagtaagtgatgaaagcatgcttcttcctcagggtgtcattctgggccaggcagtccctgatttaatgtctaagtgcacgcagggtatagaggtgggggagtgggggattcaggcactggatcctaaaataataatgctggggtccccacccatgacagaaatcctgggttggcacaagcacaagtagaacacaggtaggttagttggaggtgtgaggccagtaactgcagggcctgcatcccctcacctctggagggcctggggaggggagctgagtggatgcagccccctgcagagcctgtcagtggggctatccaattgcttccctctgcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggtatgctttcaagggagttctgcattgaccgttgtttctagaagtgtttgacagtttgcagagcacttccacacacactatcccattccatcctcacgacagccctgtgacgtaggaattattattcccgttttacagatgaggagatcgtggattaggaagcagtgccacag

SEQ ID NO: 139291 - DNA, 1026 bp, Homo sapiens
tgctttaaagtaggaacgctcagaaaacatgccacacggggaaaccaaacgttagtacggggaaaggtcagtttagaattacagctaagttcaaatgttaattttctggaagttcgtgttagttatttgaaagcacaaaagaacagaaggaagggcagagttctgatgaggaagttaaaccatgcatgtcagtagggttcttttcctgctcacagaagagggtgagcagtgagttggagcagccgctgcaactcttgcatgtcgtgtgtctacacggtgggtcccagctgaggcatgagaggcatctcagtgggggttttatctcctatgcttcttgcttacatcactaagtggctaaatgattagcacttttctgctctatgagaaacatgcagaagagtcaatctacctaagttttcatttttaaattgcagccggacagaaattcactttgctgcagggttgctttttgctaaatgctaatatgatcactgtgtgcccttatttgagtaatactgtaaaatgggagaaaagacggaaggagaactttaaagaagggaaggaccactcttcccctattgatggtatagggcagaaagtaaggacacaaagaacgagattcaaatgccattttacaggacaggagcccctgtcagtttacagctttttggcacagtcgggacaatacacttgctcctggtggaaaacaaagcgcttgttggccagattcacggagcattttttgcagtggaagcagtagtcgtgccaggattgtccttcataggccaccacactggagcctttaccaaaccctggggggaaaaaaaaagaaaagaaaagaaaacaagagaaacagctgaatgaatacaggtgaggaaaccacgattcagagagataaaatgacgacctgccccactcacagaccgacaagcacgcaagagccaggtctgcctggctcccagaccccctcctccactccatcgtgcacagtcccccacgccgccattgtcccccatgccgccgcaa

SEQ ID NO: 139292 - DNA, 1101 bp, Homo sapiens
caaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagagga

SEQ ID NO: 139293 - DNA, 1762 bp, Homo sapiens
ccactgcactccagcctgggcaacagagcgagattcccgtctcaaaaaaaagaaaaattagaggtaagacgaaatgcacaaacagaattgtctaggtgagtgatcaggggaggggtgaaaatctggagcagtcttatctctggtcattattctttcctagcaaaggaaaaaggacagattccttaaacgtagcctcttggtgcctcaagggcagggtgagtgtgtgtgctgagcagtggcctgggacatggcttgggaaactctgtgactgctgggcctgcctcccaggagtactgctgcttgactcttcctgccttcaggcaggcagtacccactccccatcccatcaggatcatagccttcactttttcttgaattctttattgaaactccatatttaattgtgtaattttttttcctagccattctaaatggcacaggctcacctaccaaatttaaaatgccgttcaacaatgccaagaaaatgacacacaagctggtatttctagaagatggtaccagccaggtccgtaaagagccaaaaacatattttaatggcgatttgaaaaacttcagacaaaaaagcatgaaagacacttcaatacaggaagtagtttcaaggtgagtcacttagccagcttatctaaataaacttggcaggattatgattgacaatcttagaatgctagataaatatgatctcttgtgctcttagtttgtaccaaacaccatgtcacatatttgacttaacggaaataaactcatccccacaacagccttgctaggtaaggatcatcatccccatgtataaagacaaggagactgagggtcagagaggctaggggctttatttgcccaatatcctgctattaaagggcagagcccaaattcaattccagatacatctggctccaaactttacttttgttcacattggttaatgttatctcataaagttgggcaagaagacatttattgagtgattgctatataccaggcattttatattacctatttcaattatcatcacaactgtgagtgtgacagtaatatcctcattttattatttttttatttttcattttttttttaagagttgaggtttcaccatgttggccaggctggtcttgaacctccttggctcaagtgatctgcccacctcggcctcccaaagtgctgggattacaggcgtaagccaccacacccggccataatatgctcattgtcaatgtaaggaaacaaggtcaaaagttaggtcaggagagcaggaactgattcatggaaaggaatgctacatgggcaattgcctgagaagacattcacctgcaaggcccacaggaacaggagtctgctgagaggtgtgatgatgtggaaggagcattagagctagaggacctgtaccaattctgttactacacctcactggccgcatccttgaccaatgtaagggaggggcatggtttctggagtcctgcgtgcttagctgctcctactcctggtgcttccgtgggacctagggctttctggaatacagtttgaaaatcagtgtgtcctgtgatctctagggttcctttcagtcatcctgttctatgattctgaaatgttttttaattccaaggcatttcttagaagttaattaaaggacaaagcttcttttaggccagagccttggtttgggaataattgggattctaaccaaactgtctctttccagaccatcttccaaaagaatgaccagtcacacaacgaaaaccagaaaggc

SEQ ID NO: 139294 - DNA, 1109 bp, Homo sapiens
gcctccacctcccaagctcaagcaatccacccatctcacccttccaagtagctgagactacaggtgcatgccaccacacctggctaattttttattttttatttatttatttttttgtagaaacaggattttgccatgttgtctaggctggccttgaactcctgggctcaagtgatgcacccgcttcagccacccaaagtgctgggattgcaggcttgagccaccacaccctgcattctgattttaatgttcttgaatttaccagtattttctgatgactaatgaagttaggcaccttttcataaatgcttagtggcctgttggagatttgctttggtgaagtaccttttcaagtcatttgcccattttcctattttgtcacctgcctttttctgattgaattgtaggtatttttacctacactggttaggagtcctttggatatatatattgcaggtatcttcttccatgccatagtttgcctcacactctcctaatgtctattgatgaaccagacagaagttcttcattttaacaagttcaaatttatcattttttcccttatggtgagtgtctttgtggtctgtttcatcattatttgcttaccccaatgtcatgtcttttgatggagcacatgtattcaaggcctttttcctccagattctgtgctttttacattctatgctacaagactgatattttgtctgtttgtaattacccagttgtggtcatttgcattaaatgacatgagaatttagagtagaaatgccattttcaaaaagcgctgggagtcatcatgtcaaagttcattcaactcattgggagttttccctcaagcagcaaccaaaggctgggtgcggtggctcacgctggtaatcccagcactttgggaggccaaggcaggaggatctcttgagcccaggagctcaagaccagcctgaacaacacagtgagaccttgtctctataaaacagtttaaaaattagccaggtgtgttggcacatgcctatagtcccagctacttgggaggctgagacgggagatcactcgagtccaaaagtctgaggctgcagtgagctatgatcgtgccactgcactccatcttgggc

SEQ ID NO: 139295 - DNA, 1048 bp, Homo sapiens
gaatcagctgaagactaaagactaaaattatgttaaaagctctaattggttcgcaataatatatgcttagtctaatgaatttctgcatatgcaaaattaggagtgagatgttgtcatttgaatgtttgtgttataacaaatacagcggtcatcattcagggcattttatagctgaaactgggattgggataggggactcaactgccaccgtaagccttttgttggtaatatttgtggttttggagcaatcactgccattgtgcacctctgtgaaatggggataatcaactcctttaggacaactgtttggtttctaatctgttttcatgtttgaatttttattttcctttaaatagagaatagaagaaattatgaagcggacaagaaagacagatgtgaatgcctcaaaggtagtctccatactcctaccagcagtgtataagaatgcctcttgtttcacattattgccgagtttttcactttacccaatctggtggtaatgaaataaagtattacatttgcatttccctgattatcaacaaggttgaccatgttttcatatctttagttagctctcatatttcttttgtgtgaaatgtttttttttatcttttgcccaagacttttgggttgatttgtctcattgtggttctttaaatgttatagatactgcttcttttttggttatgtgttgcagataccttctcccagtttacagcttatcttttctttttctttttttcttttttttttttgtatacaatgtgtaatgatcaaatcaggataattagcaaatccatcacctcaaacgctgatcatttctctctttttttttttgagacagagtcccgctctgtcacccaggccagagtgtagtggtgtgatctcggctcactgcaacctccacctcctgggttcaagtgattctcctgcctcagcctcctgagtaactgggattacaggcatgcaccaccatgcctagctatttttgtattactattagagacagggtttcaacatgttggccagactggtctcgaaatcctga

SEQ ID NO: 139296 - DNA, 1040 bp, Homo sapiens
ctgagctcagactatactcagtttgaattattaccatagcccaatttatatttccagtttttagtgtattattcaccagcattggtcatatgttttatatatgattgtttatgcttgcatttctcaggagggtgccttcaagaatcctctcagtgcttttgagaaatgtcaggctgttggctcctgttactgtgttaatggatagctccacagtcacatactttgaattaggatggtgtgatgttcataacaatgaccctgtggtcctgaatcctcaggataacatttagcctagctttgtgcattctaactagtgctttgaaaattgacaatccgcaaatatcatgatataggaaccctcattcaaaaggttacactcttttgttatactagataacatttaccattgaaatttttaaactagagttctctgatgtcactcaggtatcttgagattgaatgatatttttatgcaaatttcctagaaaggggacgccaaaataaaagctcaagaggaagctgacaaacgcaagaaagaacacgagagaattatgttacaaaatttacaagaacggttagaaaggaaaaaggtactcgctctctgtttggggggacttgattctgtgtttaaaacaatgttgggcacctgatatcagcatgtttttaaaaatcacaaatctgatatatgctagttcctggtggttttcccactcgattctcttccttatccaaggatctgacttctcctacatagagggctgtcctcttactgatcatgcctccctctcatggacccttggtggccattggccattacagtgatgcctcactatatcaaacctctggtaacaaaacttctctgagcagaaggactccagtcatggtaggggttggtagaagttaagactttcttctaaactggctggaaattgcagcaactacatggggagaagcacaaactgtaggcctctttgagaggccaaggtgcaggctatttttaaggtagggccacatgtgagctcatctgcagccctggtcca

SEQ ID NO: 139297 - DNA, 1031 bp, Homo sapiens
ttttacaacataaccagcatattatttacaatattctgcaatataattaataaaataggttaactcacttaaactaggaatttaaaattctctgatgttcattgtaccacttttcctccaaagctgaaatattagtgagtttttattagaagggagaaaatgtaagtttatatgaactctgtttctaaactctgaagaaatgttttttgagaaatgttttaaaccctgagttaggatttggaaattgagtttggttttgaaggataatatttcttttaaacctgttatttctgtgatctcctggaattgtgtaatgtaaattgttagtccagaagcaaatatcaatgtcctgattctcatactctaaaagaaaattgcagtttaaagaattctaattgtgttttattcagaatgtttttctcttcaaaaaaaaaaaaaaagccagctgcagtaaaagaattgtttgttagtaatttaccatactgtgtttatctgttcagaaatcagaaatggacaaacaggccttaatccctattgccaagaagcgtctatcatcatacactgagtgttataaatggtcatcatctcctgaaaatgcttgtggtctgccgtctcccatcagcactaagtaagcagcttattcgcaactgttcctgataggcgttttactagaacaaattccatgtcaatgtttgatgagtgaaataatatagtatgcatggtaacacaaatgtaaagggaaaaaagcctgtaaaaagggatttatttttcagaaaaattccctgattataatgtcatctcataatagcatcttatattttatgaaattgtacactgaaaattaattagcaaatgtgtattactttttctcagcaggcaaatccaaaagaactgccctccatcaccattaccacttatttcaaaacagtcaccacagacttcttttccttataaaataatgcctattcaacacaccctgtctgtgcaaagtgcatcaagtactgtcaaaaagaaaaaagaaacagtttcta

SEQ ID NO: 139298 - DNA, 1472 bp, Homo sapiens
ttttttcctaagggtaaacctagaagtagaattgctggaacaaacagtatgtactttttatgctccccagggaaaatatacaaatctatactcccaccagttgtgatgaggttgcctggttccaaacattggtattaatcgctttcttccatcttacctggcaccaaatattatcattttcgtccgtttcataggaaaaataaaattagattgttaaaggtggaaaggaccttggagatccaacccactctgattaatgtcttattaagtttttagtatgggtgagaaaatgctctttcttacattctattctaaaacattaaaatatggagtatcttacataatcacctataatggtaagatctctagccctggcgaagatgtttagattacttttagaaagggttgaagatcttgtaattttttgtgaaaattattctgaaatatagtatgattaaaatagaaacagcttattgcaaacatcaactttggagaagcatcttattttcatctgtaatagactattgcctttacaacgactgttgttaatgttgcttccgaagtagtgactttgtgatagttctgtcctgtgtctgtcatccatttcactaagcatttcctgtgttgtgtgtaatccctgtgctttcctaataaacaatctcttttctgtgttcctgttcttatactgtgtacctggtgcatccttttcttgtcagatttctaacttagggaatttcatgctctgtcctcattcagttacaggcgtcaccaattatgtaatgcagtatgtcactgtacccttgcgtaaatgtactagcgacgaattgagggctgttatgtttcccatgtcgacaatgaaaatacctcctcaaacaaaagtagaagagtctcccttggagaaagtagagacacctcccaaggcaagtgtggatgcacccccccaggtgaatgtggaagtattctgcaacacaagcatggaagcgtcccccaaggcaggtgtgggcatggcccctgaggtgagcacggactcattccctgtggtgagcgtggacgtgtcgcctgtggtgagcacatatgattctgagatgagcatggacgcatcccccgagttgagcatagaagcactcccgaaggtggacctggaaacagttcccaaggtgagcatagtagcatccccggaggcgagcctggaagcacccccggaagtgagtctggaagcactgccagaggtgagcgtggaagcagccccagaggggagcctggaagcacctcccaaggggagcgcagaagtagcccccaaggagagtgtgaaagggtcacccaaggagagcatggaggcatctcctgaggcgatggtgaaagcatcccccaagacatcccttgaagcaagcatggaagcatctcccaaggcaaaagcgagagacgctccaaaggtttgtcaagtgcctgttattgacaaattttctattaaa

SEQ ID NO: 139299 - DNA, 1028 bp, Homo sapiens
acatgtataactcagataatttgttttctttatgttaagaacaaatatctttttatctaaatgattgatattggagtttcatgttttcatcattttatactggtgtgtgcacatgtgtgtgtacatgtgtgtatacgtatatatcttttttaaatatatgcatatataacaaaaatactagttataactaaagtgtaaattacttttaagtattaggcatcatgtctaaagggttgtatgtttataatttgggaactttgatgtcagatagtgtcagatattttacctcttaatttttaccattttctaaattttttttcatttcagataaagaataaactcattttaagcttggggatatagaatctctgcataatatttgaaattaagtcttataagcaaggtagagaacataaaaaatgtttgaaaaaggagtatctcactcctgagataattagtagtttatgaaaactaatattccttttgtacttgctctctagggaaaacagacaaggagagaagctcatctttaaatagaagagatagtaacctacattcgtctactgataaagaacaagccgaaaggaagccacgtggttagttacttctaaatacaaattttaaatagtgatttaaaagaggtattttatgtcaacattgaattgcttgaaaaatcattcccaaaattggaagccaaaatattccttcttagactgaaaaaatgtgctttggtgccatgcttatttggctaaagccagaaaaatctgtctttaaatgaagtatataattcctgccatcatctgacaaggggtggataatgcagctggggaaataaatcacagaatattggtatagataggagtgtactggaggatttgattcacttccagtatttcattaatttgtatttggaagtttaaatacccggccacatttcgaacttcaaagctttgcccttgcttcatagcattacccacatatatcctttgtgcatattttcactgctgattattcacagaatttcacag

SEQ ID NO: 139300 - DNA, 1152 bp, Homo sapiens
gaattttagctgttacagatgtgagtatactagatgattctggtataaatttaacttatatgtgtgctgatttttcccctgcctcattctacaaagaatttaaggtgacttaaaaatacataccacaccagatgataaaaataaatggttgggggaatcaagcagaggggaaaactaacataggcaaataaaacataaggtatgattagcatgcacaaaagtataccaatcagtctttgtacagttgctagaaagaggctacacatttggctctaaatttcctaatgatacaaacaaagaggaaagcatggtcattttcttaatgcaaggtccataagataaaaaaaaatgagttatttaggagaagcactggtattgattgatagctgagacatatctccaattattttaaacttttacctgagacagaaatttggttatggtttattttataaaccacagatcaaaattatactaatttgatgaatatgtaaaaatatgttggcttttattttaaataggaaaaatttacagccattctttatcgtactttggaacggaggagacttgctgatgattatcagcaaaaaagatggtcatggggaggctctgcaatggcgaattctgagagcaaaactggtaattaatacacccattaaattttaagtttgtttatgttcttgtttaaatattggctatgagtagaagcttgcatttacagcaagattttagtgtttgtatcctaaacaaaaatactgtatatagtaaatttaaatttctgtcatatgccattgcaaaagaaacaggtgaaatgttatagtagattttatttagctcaatatacctaaaatcttatttaaacttataatcagcagaaaaatgctgaataatgactaagctttacacagcttatcaaatgcatatttttaaaaataagtctgccttgtctactattgatttagtgtaaattttcttatatgcacataattctacacaatttcagaaaacaaaagtaaaatttatgtagtttagaaggattggccagttgccgtggctcacacctgtagtcccagcactttgagaggccaaggcgagcagatcacttgaggtcaagagttcaagacccgcctggccaacatggtgaagccccgt

SEQ ID NO: 139301 - DNA, 1050 bp, Homo sapiens
cattaatgtaaaactggcatgtttaatatggtctgtatagatgaggactttgaaagaagtttcctagtagaagggaacaaaacatgtatcctggccatgcagtttttaataattagtattttaatgtacagcatattaatatggtagggtttgactttagctcaaatcagcagaaatatcacatgaaagaaaatattttttcttaatttggaattgtagtttggacaggatgagagtcatttggcacagacaatccagttctccagagttaaatgaatactcagtgaaaatggttctgcagtggctacctctgttcacttttataataaatctttagttactagcacaggttgtgttattttaagaaagtgaatgagatgtgttaactttttccttctgtgtgtgtaatgtggaaaacctaaatattttcttggctcttacaccttgaaaatgtatttggaatatttcagccaataaagaaacacaactacttgaaaaagaaagaaagaccaagctccaatatgaaaaacagatggaggaaagacagagaaagctgaaggagcgaaaagagaaagaagaacaacggagaatagctgcagaagaaaaaagacaccagaaggatgaagcacaaaaggtacataattttgcagcctgtgcatgagaggataaactgtgttgcctgagtctagaatattgttttctcaggccttctctgccttacttgccctgtagaaagggaaccaatcccagctctttcttcttcgcttcctcttcccctcagcattatataggcttttacccatgtcctgataagatgccaggagctgagacccactagcctagggaatggggagacttccaaatccaggaacaaagccccatccaccttcaggacttggcacatgaggtacctgtggcctggggtttgttctgagtggctctgtttactaccaaaaagtattcactgttgtctcattgcctacagaataggggcagaccccactgtctgaccctccctgacgtgccctcatctgaccgatttctcacaac

SEQ ID NO: 139302 - DNA, 1134 bp, Homo sapiens
ttctgaattcccaatttatggtgaaacttaattttcccaattcctcgccagctcagtatttctaacacttggtgtaatgttttgtttgagacatttttaaaacctattaatcattggctcctactcatccacaaacttatgctgccaccgccactaacaactcaattatctttatgtctacaaataccctggcccatcatagtaaacactttaaattctttgttaaagtgttgttgaagatcataggtgttcaatatatctttgttgttgacccagatgaaatcagtcatgatttatagaagtgatcctatcctttatcatcaaatacaattggccgtggtttgctgactcctgtgttagctatccgtattcttaacatctaatccttttatctccctgtattttagttgctgcagcaaacgagattgctaaggaaaggaggaagcaagatgtggttaatcgtgttgcaacccattcctcaaatataagatcgacatttaaaccaggtataatttctctgatgctttgatagatgtcaaagtgtcatatctttaaaatttgatatcctattaatatctaactatattcttttttttttagtaatcgatggatccatgcttaaaaatgacataaaacaaagattagcaagagagcgcagagaggagaaaaggagacagcaagacggtatattttagaccttttttcaaaaatcaaaatgaattgtgttatatattgcaaagtgtttttaacttattcctcctaatttgtttatatgatagagtataatttttatattatgtattattttggattaaatccttttactaaatcaggcaagaaggcccatgaaaattctttgattaaattgtttaatttttgaaggagtagtttatcttagctttgattttctgaaaactaaggtctggaaatttcttcaatatttgtaaaaacaatcagaatgggatttcagtaaaagtgattcttttttttttgttttgttttgaggcggagtcttactctgtcacccaagctggagttcagtggcgcgatctcagctcactgcagcctccgcctcccgggttcatgccattctcctgcctcagcctcccgagtaactgggactacagtcacccg

SEQ ID NO: 139303 - DNA, 1028 bp, Homo sapiens
aacttgggtctttctttgtgtaatgtttcaaggactagtaaactcatgatacaagcgcacccaggaggcacgccgtaaatgttctttaaatgaatgaatgaatgaggaaggaatgttactgtgttgctaggtaaaggtgaagaaaggaatgttgggggggccaagctgggtgctgattggctagtcctcacaatgcagtaggggcagagcacggaacataggagagggtttctttagaccaggtagtcgctgcccagccggtcaggacgtgggacgcaaggggcaatcctgcccggttcgcaggtccgaggcgggcgcggtggcccttcgggccccgccccgccccgccccgccccgccccgcccaccggcagcccggccacgacccaagcggaggccgcgccgacgcctgcgcaatgtatgcggagagccaccaccgcctccggtcccgactccgatgatggcggacggcgccgcagctggcgctggcggcagcccatccttgagagagctgcgggcacggatgggtgagcgggcgggtggctcccgggggtggttcgggcccgcgtgggaggcagggttcccgcagtccccgggccgtcggagcggcgcagcgggcgccacaaaacttttccctggagtcgcctcgtgctatctggtcctcccctcacccccgccggagtgccctgggatgggacaggggcgggggcggggggttgaaattgtcagccgacgccgcgagccgcctgagtcccgccgccaacggtcgaactgccgctgccaacggtctgagccccgcggacgcggcgcgaggcaactcacgggctctgcttcgacgggcggggcgggggcggctggaagccggaccccgcggaccgccccgtgccccatctgcccttggggggcggtggccgcccgcgcaaccgccccaacgaacgcacagctgcctgggatgtgcgggcgcccgcagggactccgcgcgccggcgccgcctccgccgccaggcagcctttccaggcacggaaagtt

SEQ ID NO: 139304 - DNA, 2626 bp, Homo sapiens
gccgcatgccggcgtcggcgctttttgacgccatagtgggcgtgtcggcgcgacccgcgacgtcgccacgcgccgacaatggcggctgcgtcggcctgagcagggcttagtttagaagtaatttcctgacgttgccgagggagccgcagtcgcctcagatccggtcggcggcggcggcggtggcggcggcggcagcgcgcctgcgcgctcccgcagcgccctggacctagcggcggtgccgaggcccggcggagcaagccaggtgggcggcggcgcggccgagctcacagcatcagcgcgcgcgcgcggtgggcgggcagagaggggggcggtgcagccgccgagcggccgcgatttcccggggactgctggggcgcagcggggaggcgggccggggggcggcggggcgcgagcagagcgcggttgacctccctttctctgctcagctccagcgtcatttcggcctcttagttcttctgaaccctgctcctgagctaggtaggaaacatgagcggcaccaacttggatgggaacgatgagtttgatgagcagttgcgaatgcaagaattgtacggagacggcaaggatggtgacacccagaccgatgccggcggagaacccgattctctcgggcagcagccgacggacactccctacgagtgggacctggacaaaaaggcttggttccccaaggtaggagagtgccacgggcgccactgcagagcgggccgcctggccagcctcgcggggcactccttttacgtttgctttgctgagatccttggtccttggtcctagcccccttgaatagcgacgcttctttttgttgtgtttgttggggcaccgatgtgtaaaagaacgtaaatctttagggtagtgtcttaaatgtaatttttaagtcttttctatgctttattaatcttgtctgtgaaggtcacagttgattattacatgactgctttttattgcaaagaggaaaaataccaagaacaaatttagtagctgtccatttctggtagccaaccccacttgtcctaggaactcagatgtttagcttatgtactatgtgcaaaatgcagtttcttgatttcttttttaaagtagctgtttatatagctttactaattgaactttctttgcaccttgctttactttcctagtaaattttgtccctaggcatatatgtttgaaccatataaccacaggaataagactggagatacacagaatacagatggaaaatctgtgtatgtttgtttggaatacttggaaattgctaagtatttttatttcagcttcgaagtaaaataactaatgttaaacttgattctgtaaactttgtggtaaaagtgcccttttaatctggctctcatgagcaggaaagggcacactaatagcacacaaattgacttgcaagtcaatgatacaaaacctgtctccactgcgcgactggactgctattgtaaaaattcttttgcaacttttctttcccattctgtatttgtatatatattccaatccctccagattgttaaaatttacgatttcacttctgtgttggtagtgctagtttgagtgcagatttggtttcttcagcattctgaatacttttaacaaaggtgtgataatggattaatgtgtgactttatccttttatgttgttgaagcccatacctcttcaaactttgggttttacattttccccattccatgcctgcctaatattgattggtatgatgatataactatatttctttcgttttgcaataacgcttttcccccaaaggggaggaagatagatatgagttggatttgtctttaatttgttctgatactaaaatataacgtcatttaatttgtgataaagttaaaatgagcatttagttttacaattgttaaccccattctttatataccaaatcagagttctgttctgtgtgctctctgcatacagatatttaagtacttattgtacatgtatattggtgcatctgtacagtaagagaaaattggattctgtggttagattattcattgactgttggtttttattgttttattatctggttcttcctttgttgtatgtatttgtagccttagtcaagtagtgtagagaggtagtaattaataaatgaaacaactagaaaaggtgccagcatcacttaaaatgctttaaatcgtatctcagacttttgcattgatcatctaagtacttgtgtcttattttttatcaccgtatgcacaattttctatagaaggtgactattcttgcatttataccttaataactacaactattatccacagaaacacttttgtgttaagttgtataactatgctgtaaaaacacaatttaaacttcttatgagtggaaataattttgaatttctctgtccgggtctgttgaattgcttgtgtagattactgaagatttcattgctacatatcaggccaattatggcttctctaacgatggcgcatctagttctaccgcaaatgttgaagatgtccatgctaggactgcagaggaacctccacaagaaaaagccccggaacccactgatgccagaaagaagggagaaaaaagaaaggctgagtcaggtaagtggttctagcttacaaattt

SEQ ID NO: 139305 - DNA, 2528 bp, Homo sapiens
ctgttatttgaaagtaagttgtatgatcaaataagtttcttgtatcttcgtttttaactcaggaaccagggctataatttctatagatgataaccaacaccaagaactgttcaaaacaggatatgaagaaaactgaaatttcagttagtacctgtgtgtatcacattggtaagattattcacttgttttaagaaaatatgttatcaggtaaaagtattatataagtatgcgactggagtgcttcttctgtcttgaaaaattctcactagaaagatttttttattgatgtgtacagtcaattcagactacattttaaaaattcaagaagaaaaaaagccagtaacattttagttgtccattggaatgaattacaccagggttcagcaaactcgggctctgttttggtaaatacagctttatggaacacagccacactaattcatttatgcatttgtctatggttgcctttgtgtttcactgatagggttgagtggttgcagcacagaccttgtggcctacaaagcctaaaatatttacgaactggccctttaacaaaaggatttttctgacccttgaattagaccatgaaggagacgatagcttattcttactgctttaaaatatttttttgaatgtgagaaaagagagagtggtattaagagaaatttgcagaacttcatgtagtcatagtaccataaattacacaaagaaacctcaatgccagaggcagccatcatttctggaacacctgccaccttaggagcatgtgttatacattatcacagggtacagaacaaatgatgacatgtacataagtcaaacctggaaataattacagagtaaagtcaaaatggtaaagcaaaagtacaaacaccacaggtgtgttgtgagtatacagtattccagtgagatcagaagagagtaggattaagctgacagctttttgggaaataggtttttgacctgaatcttaaacgtgatggttatgggacatgagcatgaccattttaggatggtagttttgtaatgttcaaatgtaaggagatttgagggttttataagttctttaaggattattaaaaaatctgcgaacagattcttagggagttctgttagattttttaaatttttaaaggaaaaaaattgagttttgagacccatagaagtacaagattgtcaaaacagtaaattgagttccaggaaaatatagtgaattattccaggacccatatatgtgagcagctgagttcagttatccatttttcttttctacaggtcctctgatctttgactctgtttgtatagggctgataactgtcctttctctaagacctggaatccatacatgtatttaatataaagtacaagtcatcagataattgtcttctacttctcagtgtattacagactcacaatttaatggatgaaccaaaaaattaaaggctgtctatggtgttcccaattccttgagtcatctagtcttttaagtaagagtattatagaattttaaaagaaatacaccttagaaatcatgcagatttgctcccttcattctgcaaatgagaaattgtggcctcaagagacaaaattacccaataataatatttattgaacacctaccatatgttagtccttatcctttccatgcattatttcatttaattttgtcaagaaccttgtgatgaaggtattaactatttccattctacatacgacgatattggggctcaggaagcttgaataatttacccaagttcacacagccggttagggacagctgtgtctcagatgcgggtttcctggttcagattctagagttctttatctcaaagagagaacgagatctcgtatattcataatatataaatataagaatttaaattattttatgtataatcatcgttcatctaaaaaactcctgaagttttatttcgttgtataactgactatattttgtcttacatttataaagagagaatctgtggaacttgcattaaaacttttggatgaagatgaaattagaggctacaaattacatgttgaggtggcaaagtttcaactgaagggagaatatgatgcctcaaagaagaagaagaagtgcaaagactataagaagaagctgtctatgcaacaaaagtttgtaatttttttcccttttgaaaggttccatatattctagagtatatttttggtaatagccatctagttttattctgtcaagtgtgcctacacattattttaaaataatttcattagctcatcaggtacctttagcaatctatacaataggtttagatttagcagtggtggggattttaattttccagagtgtctatttgtaatataataagggcttaaatgagctaagagaagccatctgtttggaaaacgttgaacatcaaattaaataagatagtttaggcttatgtaccagaaccgtttacttctgtgtggattgaaatcagtggtaccaggagctaaatttttctatacaggtttgttataggaattagaaatgacaggatttt

SEQ ID NO: 139306 - DNA, 3051 bp, Homo sapiens
ggaagctaacactttagaaattgaacacctggctcaaggttgttcatttggtaactgacagagccaggatttaatcccagggcaatatgacttcagagtttacactcttaacaattatactgtcctgcttctcattagacagggatgtcagcagaaacatttccaaggacattgtgcttggttcttgctaggtaagattgaggtaaagaagcagctgactgcacgtgactggctgggataaaatggaagaaagacttcatacataaagtcttttacttcagagtatcagagagaacactactacttacctactttgtgaaatgtatgtgttttatttttaatcttatcattcattccttttttttctttcttatctttctagaggcacccagatggtgtggcctctgtgtcctttcgggatccagaggaagctgattattgtattcagactctcgatggaagatggtttggtggccgtcaaatcactgcccaggcatgggatgggactacagattatcaggtaaattttgctgcttgtcaagggcacacacattgtttcattaccaacaaatactgatccttcagatctaaattttgggtttggtttaacctatttaatgtaacaatgcttcttttatttttatttacttatatattttaattttttactcttcctcttaattatttacagtgctgcttttaaataatattttgcattcagaagatagagaaatgtttgagtctttcagtttctaagtctgaaagtttgaggcttgttcagaatagtgataagaaaagaacacattcaaccaaatgttactcttcctttgtatgctgtaaagtatagacagagctcaaatattaactttttaagagatgagacatttctgcagtactgtgatatttggcctttatttaagtggtcttatttaaggtcaactctagtaaatcaagatgtaaagttttgaaaactgaagatggaattgctttcatttcctaataagagatgctttataaaattaaggttgtttcatcaatattagatatgttcagagaagtaaccttttgcctgaaacttattttaatggcagtctccatttatccacaggtggaggaaacctcaagagaaagggaggaaaggctgagaggatgggaggctttcctcaatgctcctgaggccaacagaggccttaggcgttcagattctgtctctgcttccgaaagggcagggccttctagagcaaggcatttttcagagcaccccagcacatctaaaatgaatgctcaagaaactgcaactggaatggcgtttgaagaacctatagatgagaagaagtttgaaaagacagaagatgggggagaatttgaagaaggtgcttctgaaaacaatgctaaggaaagtagccccgaaaaagaggctgaagaaggctgccctgaaaaagaatctgaagagggctgccccaaaagagggtttgaaggcagctgctcccaaaaagagtctgaagaaggcaatcccgtaagaggatctgaagaggatagtcctaaaaaagagtctaaaaagaagacactcaaaaatgattgtgaagagaatggccttgcaaaggaatctgaagatgacctcaacaaggagtctgaagaggaggttggccccacaaaagagtccgaagaagatgactcagagaaagagtctgatgaagactgctctgaaaaacagtctgaagatggctccgaaagagaatttgaagaaaatggtctcgagaaagatttggacgaggaaggttctgaaaaggagcttcatgaaaatgttcttgacaaagagttagaagaaaatgactctgaaaactccgaatttgaagatgacggctctgaaaaagtgttagatgaggaaggctctgagagagagtttgacgaagattcagatgaaaaggaagaagaggaggatacatatgaaaaagtatttgatgatgagtctgatgagaaagaggatgaagaatatgcagatgaaaaggggcttgaagctgctgataaaaaggcggaagaaggtgatgcagatgaaaagctgtttgaagagtcagatgacaaggaagatgaagatgcagatggaaaggaagttgaagatgctgacgaaaagttgttcgaagatgatgattccaatgagaagttgtttgatgaggaggaagattccagtgagaagttgtttgacgattctgatgagagggggactttgggtggttttgggagtgttgaagaagggcccctatccactggcagcagctttattctcagtagcgatgatgatgacgatgatatttaatcccttaaacttgctttttagggagagtcctccatctacatttgcctgtgcttcagggtaattactagtagtgttacatgaacatgtgcatagtggtaggatgccatcagattaaagcattgaagtgtttcattgttacctgtacctaatggttttaaatatatgttaattgattgtttagttaaaatgtcatagttacaatgcaagtaaactggatacttgttcttttgtcagatttgttaaatgcatgcagaataatatttttaagagtattgattgaagtttgtgatattcatcaataaaaatgagttgataatatgcagaaactgaaaattggacttgagttaaattgcattttaaattcttgatattgctttatttatactgaaggttggcttttctgaggacttgaagaatctctttggagtctccttgcttcccgctggtattagcacgtatgtctccatttcctctctataaaccagaacatgttcctaaactcagaaaacaaccctctggattttttttttctgcccagtccttgcaaattaactcttgtttgttttctaccctctttccattaaaattgactctcagatgtgcaaaagtgaacttcctgcagtctacagctcccattattattaaaaatctaaagaaacagattagaattctaccttgtactgttagcgtctctgggcccctttagaagttaattcaaattagaggacctcttccca

SEQ ID NO: 139307 - DNA, 1453 bp, Homo sapiens
gaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggcatctttttttgtggcaaggggctcttctttacttagaaattaggggtttatgtttttaaatgtttttcccatgtccccctcccccaaacactacctctgttgcattgatggcacttaatcagttttgcatgggaatgtccagagtcattgaggctgtttttgtgactaggcctcctttattgagagtgagcttcagggggaatgtagatgacttcattcagtcctcaccctaaaagttaaatggaagcacaatcacacacctaagaagcagaggctaaataaaccaggagtcaactgtagtgcttttatgtaattcctgcttacctcttggggaaaaacaggtcagcaacaactcagttgtggctgtggattccaaatactttgggtcaagcaatgcatgtgataatatgcttctgaatttgcagttttcagtttctctgcttta

SEQ ID NO: 139308 - DNA, 1543 bp, Homo sapiens
ggctttattaatagagctgttgtttaccaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaaggtaagtgttgaaagcaatggcctttgaaggtttaaatgttgtgtaactaccatttagtttagctgtgacattggcaagttattgtggtcctcacttcatctgtaaaagaaaacgctgcttggaattgatgaagttaagtgctttaatgtgtagtgcctgacacattcattgtgaatttagagtgaggttacatttccgtgagtctggctcattcatgagattattcttagctatttttgaacccataaagcttgcttatagctcttcatatgcaagcattctcaacaaggaagtacacacgtaagaagtttgctcagctgggcaccatggctcgtgcctttaatcccaggactttgggaggccaaggcgggcagaccatgaggtcaggagttcgagaccagtctggcaaacatggtgaaacctcatctgtactagaaaaaaaaaaaaaaaaaaaaacaccgggcgtggtggtgtgcgcctgtaatcccagctactggggaggctgaggcagaattgcttgaacccaggaggcagaggttgcagtgagccgagatcacgccattgcactccagcctgggcaacagcaagaccctgtctcaagaagaggaaaaaaaaaatttgctcagtgcattttgtaaaaggatatactttcgttgttactagttagtgcttgctcatttgcatagctacaatacaaattgactaaatgtggagttaatgatgcaactgtggctgcaagctccctgtttaacataattttattgacattgacataatgacga

SEQ ID NO: 139309 - DNA, 1110 bp, Homo sapiens
tgcttgcttaaattggcagccttatgtgttttcccccaacagtgaaaatacaatttaaaaattttattaacaagatcaaatatttaccattgcaatatgaaggcaagttctacagttcaaaattgcaacttatcactggaaagtggctgagtgtctactataaaataacaagctctctggaatatcctcttgaaatacacaccgtcttcagtcttttcaaacaaacattaaaatgaatccaattccatatctcagcagatgagcaaatccctgttatggccagcaatggcagagtttaaaacctcccacccagttgagaaagtaaacttttaatacaagaattctgtaaattcagatttaaaatgttgtatatatacaatttatagtgttgccatattacctgaccattgaccctgcaggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacct

SEQ ID NO: 139310 - DNA, 1787 bp, Homo sapiens
ccgacctatttaaataaagctgagggggtcgagggaaaacaaatgagggggcccgtttggttgtatgcttctcgagaaagtttggctgccatctgcgggagttggtagcggaggtcggggctttgtaggctggagcggggcgaggagcgaccgcaccacggcgatacctgcattggtatggcgctggcgctaatgatgggcatgtggacttccatgcgggctgcgggcttcgtattcattggcggccccggagaagaagccctctgaatgttcccagccaatgttggtggtaaaagttagtcccctgaccagtgtcggtggttctgggttgaatccaagtgtcgccattttgtcttttacacgcggtttttaatgacgagttttaattaggttccgctgcagtcacggagtgtcgagtgttagtgtgtgcgtccgcgttccgttacttaatagcaaacgatgttgacgatttgtttttatctttttggccggatagtagaattttcggtagggcgggggccggtgaagaagaggggcggcataacttggcttaaacttcacatttctccttggatttagtagggaatcctaatgaggaaaagaggagtcgttggaagagggcttggtgttaaggtcctgtgtctagcctgtgaccttgggagtcttttaaaaccatcgttaggaagggtgtgatgagtaattgaatctttcaaaggcaagaggactggaactaaaagttgctttttcaaatgttaagcagctgttgcttaagaacagctaagggtgatcaagggtagtggtaaaagttaagttggcccttttaaccagttttatgtaaattgcagtgttactaaactacttagttcaaattgcttcctactgtggctgaggcttagctcgttatcgttttctttagttattaaggaacaatggttttagtggaaaatatgagaaatgtgcgaaagtaaaagtgtccaataaacttgaggaactttttgcagtgaggtaatactattccttttcaacagactcaccggcccaaaaaaaaaaaaacatggttgaagcagatcgcccaggaaagctcttcattggtgggcttaatacggaaacaaatgagaaagctcttgaagcagtatttggcaaatatggacgaatagtggaaggtgagttgtctggcagtacaggctgggctattataattaaaatataagctatgatgaatttgattgcattgatcgtctgacatgataatgtatttttgtcctctaagaagttctgagctttctgtttacacatttactttggttatttcatttgacctagggtaacactttatttttctgaaaactactttttagtactcttgatgaaagaccgtgaaaccaacaaatcaagaggatttgcttttgtcacctttgaaagcccagcagacgctaaggatgcagccagagacatgaatggaaaggtgagattgtctacacgatggatgataacctgttactagtgcataaaataacatgtagttgtccaagtctggtctaggacagcttttgagttttcgttgtttttcagtatatacctgtctgggatccactcatcctgtttgtgatcctgttccaaagagtattctgtaattgcagaaccaaatctagtagtgagttatatcttatgctcgtaacattctctcagttcagaataattatggcattacatggtacttttttttttttttttttgatagtctccctccgttgcctagcctggagtgcaatggtgcagtgcccact

SEQ ID NO: 139311 - DNA, 1031 bp, Homo sapiens
taaaataagaaggctgggcgcggtggctcatacctgtaatcccagcacttagggaggccgaggcgggtggatcacctgaggtcgggagttcgagaccaacctggccaacatggcgagacccccatttctactaaaaatacaaaaattagctgggtgtggctcatgtctgtaatcccagctactcagaaggctgaagcaggagaatcgcttgaacctgggaggtggaggctgcagtgagctgagatcgtgtcactgcactcctgcctgagtgacagagtgagactccatctcaaaacaaaaacaaaaatgaaaacaaaaaagaaaaaagaaaattaaaaaatgtcaaagtagatcatataattccatgaagttaaaagtaaagaaatggagaaagtacatgcagaatcgtttttccattggtttcaggatttataaccagcaaaaactcaactaacatttggtcatatgattttatattcctgttttaggaaaacaaaactgtcaagtgggcttctaggtgggattagattttggagtctgtgcctcatgctaatattcagtggtttaggtaagcacttcatgaagtaaaaagtaagtagttttgaggtagaaatgtaaatatatatatatttaaattaacatattttgttatcacagatgatcttgggttacatctttttccttctctgtgactgtagtttcctctctcctcttctcccttccactccccacatacacaatgaaaaaaagataaatgtgttttaaatatgttagtgtttatgctgaagggaaagagcaatccgaaatgtcatggagatactacgtctgcatggaatgaatattggggtggagagtcagtgagatatgactgtggaagttgacactgtgcaagagatgaaaaataaaatggaatggaaacttctgtttgtgggttcaaaaagttcaggcacagtagagagttaggaaaaatagtaaccagctggggtagaggaaggtaaggatgtcataaaaatctgggaagcggtgagaaa

SEQ ID NO: 139312 - DNA, 1052 bp, Homo sapiens
ggggatagtttttaagttttagatttagaaacagtaagtaagagctggtagataagtggtccttgggatctttgccctgaagctcatagagtaatagagttaaagactatggccttgatccattggctaagaagccagtcagccattagttcaacctgtgtctcctgaacttaggttgtcagttccatgctcccaaactaagtttgtgtgacagatcttatttacttatttctctttgagaaggtactcttaaagttttctaaaaataaccttaagaatagtgttgcttctattactttatttgtaatactcttttgtaacataactttaagttcacttaatatattgatgcattgtcattgatctaaatttaacgttagaaaactgatttacataatgataatttgaatgtctttcttttatatgtacgtgcatttttttcagtgctcaattaggaagttttgagatttaacttctctttttttctttcttaaattttctagtattgtgaattcctttgttgttattcttttcttatctggaacggtggctatcatattaaggattctccataaagatattatcagatataataagatgaattctcccataagtaaaaaatgcatatgttagattcaacaaatacttaagtgcctattctgcccagttttcatcaatgttatatttctacttagagtattgcaccttgaatacaacacattttttatgcctagtgattttgtatgttataccaaatcagaaagtacagagttgagtaaatttttttaaaagaacagggaggtttattagagagttgtttgtcatcaactttttggttatatccttttttatgtgtttctgaactctcaaaatatcattattaaagattttcattgattagaagtatgagataacaatatcaaacattgcaaaatactgtaatttaggttatactgtttatactgttttgactcttgtgaccacttgtgtattggtcaatttttaattgctataacattggtcaagttccttatgtaggttaaatcattttg

SEQ ID NO: 139313 - DNA, 1059 bp, Homo sapiens
atttcaaaaatcagcttttagggttatattttcctgagaccaattctcactttgatttttttttcattcctgagcttgaataaaaggaaacagaaggaaatttctttgggaaaaaaagaagtgctgtttttggagtgactactgaagtgggaaagggggagatattttgtgtaattttgatttagacagtgaaattaaggctaattcaacttatgaaaacttacttccacttaccttgaatggaaaatcagactttttcattaagaaaaagtgtcaagtacttagccaagcaaataacatttgcttatagcatcccttgcttgtagtactcccattagataatttacttgtgtgccgtttcatataatgtcttaataaggttgtgcttaatttcttataaagtcctatgtacttttgagactattattgttgctggttttctatttcatttttgtgcctttaggtctggcctgccttggttttccttctcctgccaatggaggagctttaatgacctgtgccattgtgttatgggtccttctgggaacccctgccagatatgtgtctgctataatgtataagagtaagcattacaactgttattattccaggaagttgttgcgtgaaatgtagaaattaaaaggctgtgaagtaaaaaataaaaaaaattgcatgggggaattttagccgacttatgaaaatttaattgtgccttgattactctaaagtatttgtaaagttgactaaatcaagttgctaaagtaactattcagttttttacttccttagcatttagaggtgctaagtggaagacaaatgccttgctgacagcactattatgtccggggttagtatctcacgttctcttttccctatgcaattatatgcttccttacacttcatcttggaaaaaaaaaaatcattgtatactataacaaaaagtaggaaggacatgaatgaccattgtgctttgtgtagtcgcagcattccctttctgttgtatctgcattctttttatttttttgtacatcttaagctttagtacaaagagatggcgat

SEQ ID NO: 139314 - DNA, 1050 bp, Homo sapiens
aacaaagagcattaccatctccaccacccaagcattgggtctcccattctccacctcccaaacaaagaagctcctcagtcaccaagagacgttcaccttcattatcatccaagcataggaaagggtcttccccaagccgctctacccacgaggcccgatcaccacaaccaaacaaatgacattcaccctcaccacggcctcgagctcctcagacctcaagtcctccacttgtttgaagagcagggtcgtcatcaccccaaagaaggcagtccctgtctccaaatactaggccctttaggggagtctccaggactctggaacctaaaaaaacaaaaaaggctgcttcaccaagcccacagtctataatgagggtctcatcatcctgatctgtctccaggtctccagagccagcagcttaaaagcccccagcacctccatcccccatccagtctcagtcaccatctacaaactggacaccagctgtaccagtcaaaaaggccaaaagcccaacaccaagagcatcaccgccaagaaagccagatcaagaaggaggtgggaaaaaaaagaagaaaaaggacaagaggggggtggttccaagatggccaaataagaacagctccagtctacagctcccagcgtgagcgacacagaagacgggtgatttctgcatttccaactgaggtaccaggttcctctcactgcggattgtcagacagtgggtgcaggatagtgggtgcagtgcaccgagtgtgagccgaagcagggcaaggcatcgcctcatccgggaagcacaaggggtcagggaatttcctttcctagccaagggaaggggggacaagtggcacctggaaaatcgggtcactcccaccctaatactgcacttttctgacagtcttagcaaacggcacaccaggaaattatatcccgcacctggctcggagggtcctacgtccatggagcctcactcattgctagcacagcagtctgagatcgaactgcaatgcggcagcaacgctgggggaggggtacccgccattactgaggcttgag

SEQ ID NO: 139315 - DNA, 1100 bp, Homo sapiens
tatagcatagtgtaacgagaaaaaacttgcacttaaaaaatcagacacacctgacttagaatcccagctcttcctcttttagtggtttgaccttgagcaaagtacttaatatccctaaaagacattaataaggaactctgtccccttccataactcctgtttttcggatgtctgggttgttcatctaattttcctataattttttgcctgttttcaatttttttaaatgctgctttctaagacagtttatcatctctatcttccaacccttttattgaggttttaattcctcttgtcatatttttaattcccaagaggctcttttgttttctcaatagactttaaaatttctgtttcttgttttatggtcgcaatatctcctctaatctttccgaggatgtcaatgatagattttctttttaaaagtttccttctaagcttcagggatcttccccaagagaacagacctccagtattctgctggtgttggggaagggaagttatttggccctgcagaatagggcaaggaatctgcaagtcagcttcctaggctgactttcaagcagtcctcctggttattacctctctttcatgcctacttgcaggggtacctggtactacaagttcctgagcccttttggaattctgtggtataagtggatttgcgtttcagctttccctactgatgacttgggatgcaggtttctcagttctggtgattcagttactatttgttcagctgctatatctagtttccaacatttgttgctagtatcttctctccctattctcctaccttgtgtgtttatgccattttataattcccttactgtaattttatcagggttttgaggaaggagcagagctaaacgtgtgagttaaattatctgccatctttaaccacaagtctcttaattctttttttgtttttttaaattattttattttacattcaggggtacacgtgcacatttgtttcatgggtattcttaactcttcatgtcttttatatccatctcttttcattttaaccatcaccacattatacagcttcttaccacttcctatctgggctcctttcctctatcatctcgtccctt

SEQ ID NO: 139316 - DNA, 1070 bp, Homo sapiens
gttgaagctacatgtaagcgatgattgtgctgctgcactccagcctgggtgacagggcaagctattatctcaaaaaaagttacgtttataacattttcctgaaagtatattgttttcttttgttgtacacatttttaaattaaaaatttaaaaatttaatggacatataatatttgtacatattcttggggtacatagtgatatttcaatgcatataatgtatagtgatcaaatcagggtaattaacatatccatcatctcaaaatttattatttctttgtgttgggaacattgaatatcctcctcctagctagctatttgagactatatgacatattattattaattgttgtcaccctacagcattatagaatgctagaacttacttttcttatctagctgtaattttgtggcctttaacaaatctctccctaccccttgtttcctaatgacttttttctcccttcagaattgtctttgctgatctctttattatgatgaaaattctctggatggaagggtcatcagctgccgtctcctttgctactctgctagatatccttacaatttggtttagaattttagtaccactaacattttttggtgcatattttggaaataaagaaaaggtaaactcttaaaatactgcttttggccactgagcgatgactgaaataatacctcagtgtatatattacacatgaaatacaaaaagtcccactggagaaaactacagagaataatcattttggaataaaagatactttaaaaaattaagtaaaggacagtaacactttcaaagacattaatgcatttcctacattatcaattgtttatactgccttttacctctgatgaaccaaattaaaaggacatattgtagaaaggctgacatcagccaactcaggaaactaatagggttatacagtgggataaggaagtcaagatgtagtccaaggaatggggctattcggtttacagatttgaagttagcctattccacatatcggagaaaggtataggataccaaaaagtctcaatgaggccacacagccaaaaaactcttcaag

SEQ ID NO: 139317 - DNA, 1053 bp, Homo sapiens
catttgaaagtatatttaatagaattatgtgtgctgtgctataaagacatatttggaaaaggtgaatgtcaacaggctttctaaggcaaaagtggtatttgaatctggttttctgttttatgatgtcgttgttggtatttatggcatttgcagccttcaatttctaaagagaatgtttttaaatatgtatggagaaaattatggtgatattgatgagtctcaagtgagaactaacttatatgaccagagaaacatgggtaagtagcagcactggttctgactagagaagatacggccaaactctgaaactgcataggtaagggactattttttggtacttaaaggataagtggagatttggaatacagagttgaatgtttaggggaaaaaaagaaaaaaaaaggtttagagaagtgtatgactgtctattgtatagatttggattgatctttctgtgtgtactgttaagttaaagtttatttaaacctcttatttttattttcaggtctcattagctgtactacatgtttggcttccttttcttagtctttataattcttgtgattacttgctcagaagttacagttttgctgtattattttcatttatgtgctgaggtaaagccataagaaactaatgcatttgctatacttgcattattggaattggaagtctgtgtttagaaaagaattgaaataaatgataactgcatgtttctacaacttgggatcagttttatattgtgttttcctattaacacattttgactttgatgtggctgtcaagttaaggctgctttgatggaaaatttaaatagaaagttatttctctttggctggttattgtaattgctgcatgatattcagttaacagaaaaatataagggactgatttaatatttatcaagttcaatgatatttccttttctttttttgagacagggtttcactctgtcgcccaggctggagtgcagtggtgcaatctcggcttattgcaatctctgcctcctgggttcaagcgattctcatgcctcagcctctctagtagctgtag

SEQ ID NO: 139318 - DNA, 1009 bp, Homo sapiens
ctgaggcatcaataggcatagcacaattctggccagtatgtagaagctgaactgaatgccttccagggctgaggcaatgttatgatagcctgcacacattaaaagtcccaatcccagagggcacatgtggtatccctggaaacaaagagttgacaattgttaggataccccaagcaggacatacattacatattttattaaatttcttataaaaggttctcttttattccttttaatccattattttatggagcttatcttgtgttcttgttataactgctaacccatttatggttaaaatttcatctgaaaagtcatttttttctacttctttttacaggattatcattggtggtggcgatttttaaccagaagctttatagctgtttatctttttacgtatgcagttcattacttctctgccaaacttcaaatcacagaaattgcgagctctattttgtactttgggtacatgatgatcattgtgttgattttcttccttttcataggtaactacagaattactcagtatatttcagactctcttaagagtcttggagatagccataatgtaataaacatcaattaacaattagtggaaggaaaagggaacaaagtcatcatgttcatttttatgcattgcagataaaagattgcaaagctgagggacctggggggaccttatgtacttagctacaagactgtcccttgtgaatgttttaaaacagggatatgttccaaagcacagaaagggttatgtgtaatcacctttgaacagcctccaagcataaaaaataacctacttgaataactttcaaattagtaaattagattaattaaatatgtcatcatataagcaattatatatgaaggacaagatgtatacttctcaggattattcgtttggggttgttacttggattcatatgtgatgggaacttctgtctagattgatgcttgaagcaggtggaaaaaaatggaatgttttataaaatgctccacttggaga

SEQ ID NO: 139319 - DNA, 1012 bp, Homo sapiens
aaaaaaaagtttaataaaattgttaaagtttaatgatacaaaactttgatttataaaactaatatatgctctggatatgcaaataaacaagattattaccccctttggctatgggtagtgataagggttatttacattttctaaattgaagcaagttataagaagtttttttgtatcagaaactaggcttggacctcttttattctttttgaaatggagaagttaagctactaattttgttttcttgctttggttagagacctgcagaattcaatcagatggattctcacacccgtttgcagatgactgcctctggccctgttgctcatcctgtttgctcagcaagagaacctgttggtttttatttgataaatgtacaaatcttgagagttgggagaatcagtagcccacctcaaaactgacatgctttgtgtttttgagaaagctactttcatttgctatgacgtctggctaacaaagatctttttcattttgtttcagagacagttggatttttttcctgtttctggttaattgctaaaatctacagtgtgctgaaggtggagtaaagtatttccccaaaggattccaagcacatctcccttgcccttgaatatctgtatatctatatgaacatcaattgagatatatatgtgtgtgcccctaattacataattttaagcatatatataaaaatgtaaaatctcattgtctggcctcagtttgtatgacacaaaatactgattgtatggaagaaaacagattgggaaacagatttattctatatcatattttcctgaaaagctaccttaaaaagatttaaattaaagcaattagagcaagggaggcacatttctttaaaaaattaaagttgagtaccatactggtttttcagatgaaattttcttttcctttttctccttcatattgctcagagcatctaattccatcagaactattgtcaaataaattttatgtaaaatgtgtatttttctaatgggagttgattata

SEQ ID NO: 139320 - DNA, 1043 bp, Homo sapiens
ttccagagctcccggcgatgattattggtatttcgagggcgcttgggtccacatctagcttgggtcttcaaagggcgaggtcaagtgtaaataaggtagtacctagactgggttccccggagccattccggaagacttgggcacaaggaacgtttgggaaagaattacgatgtgcctgctagcaccacctccaccgtctcttcgcggaagcagcctgcattcagtctggactcgagggtccctagctccaggagaaggaatgagcacaccttttttgctttggaaaggttaaagcaggaaaagcccagcgctggagcatctcaaggcaaggtgctgaagagaaagtgagtgagtgagtgagtgagtgagtgagtgagtgagtgaataagtactgctctagtacttatgcatgtctggcgctggtctgggatgtcctgaggtgctttgtgacaagaacccaatgataccctggggaaaacagtagcttcagctgttagtctatctaggcatggggaacagtggcccgtcctgtccccacctcaaaatgccccattcctacaaagttttagctgactctcaccctctgtgccaggctgagcttatgaggactccagtttggcctctccagcctaccacaaacacctctctctctctcacacacacacacacacacacacacacacacttcattcactcactcactcattctctcactttctcaaaagtcttgtggtcaatgcacaggcttttgtgtcaaacaattttaggagggttatgaatccctacttcttgccactaactagcttcctgacctgggacaaattacttaagagctctaaacctcagtttccatatcttcaaaagaaagtgaataatggtggctgtctttacagttttcaagtgaattaaattatatagagcaagcagcacaaaacagtagcaactcagtggtagttattaaaatgaataaagcaatttctggtaaagtggcttcctctgtaatgtgtcaaagcaagcagagtggctcaaagtggttaatgtgc

SEQ ID NO: 139321 - DNA, 1153 bp, Homo sapiens
tctcctggcacctggagccactgctagtgcagctgggggctaacacctagtcacccccagagcggtaaaggtattccatggcagcagaacctagcaggccacagctcgtcataagcctttcactcagatttgcctgaggaccactgcctaccacttgggtggggtggttcactgcattttctatatttcagggactccctttataattccaaactggattctgatagttctagttcaagtccctgcctgcctccttcaagttcagccctatttacttcagcctatgtctctgaagttcaagtatatatatctgtctgcacagccctgattgacaagtacaatgaaaatgtctcattcctgtctggtttgcatttcattacattgggtaacaatatgccttgtatttcagaggacaaaggcaaaaaaaaaagggggggggttaattaacaatatctgtttattctcgattgaattttaaaggtatttagggcttataaaatatgtgtcaaatgataggaccatagtgaaaattctgatgtggccaataaaatctggagctgtgtgattttacgctcaccaacctgcagacacacttggttggcaagtgtgtcagcatgtcctggagatcgatagttcagcttggcccctgatgccaattaagtgctttatcttagcataaaaataaagagaagttaaaaatgcattcttttcccagctttcttcccccttcattttttattgccacttgcagtttttcttttaaaaagatctgggactctgaagagagggtggggatttatgtaaagaaagtgtcatttaccaggaaaaaaggcgaataatggtgagtttcaaggacatgttgcaatgagaaacactttgtgctccactagggagagacaggggcaccaaattcagcgtcctggaataattcccttcctggattcaaagattcatttattgaaataaatcaggaagccttggcagaacggaaatccgcttgctgggtttaaagggcctttaaaatgttgcgagtgttagattgcaagtcttttctaaatacaaaacagaagaaaagaccgcagcgtttcccttgaacttaaagaaaattactaggtcaccgaatcaggataatttcatgtccaccacataaaat

SEQ ID NO: 139322 - DNA, 1052 bp, Homo sapiens
gcgaggagtgagtgattgactttatcagtccaaggacattactctggaggcgaagaggctgggactcgcgcggcgagcggcaagcggcgagtaacgagcctgcctactgcccgctgcccgcctgcccggccgctagccggctccgccacttggcgcagcccagcccggaggccggtacccagggagcctcctggccccgcggttctgtgcactcggggagaggaggggtgcccgggacaggattggcaaactccgccctccacttactattttgcttatttttctttgtgcgcgcctgttagtttgttaaaccagatctagtccgagtcttttctcctcccttctcctccctcctcctccccccgccaacaccccctccctgctctttcttcccctcctccctcctatccctctgcaggagactcttgcagtgacggaaagttgcagcccctggtagcgccttgggggtctccccgcagtgtccaaccgccgccacccctttccgactacggcacttcggagatctcctccttcgccggtaccctctctcacttcggccggatcgcctgtgcccagaacgtcccacccatgacgatgctcctggacggaggcccgcagttccctgggctgggagtgggcagcttcggcgcgccgcgccaccacgagatgcccaaccgtgagccggcaggcatggggctgaatcccttcggggactcaacccacgccgccgccgccgccgccgccgccgctgccttcaagctgagccctgccgcggcgcacgatctatcttcaggccagagctcggctttcacgccgcagggttcgggctacgccaacgccctgggccaccatcaccaccaccatcaccatcatcaccacaccagccaggtgcccagctacggtggcgctgcctctgccgccttcaactcaacgcgcgagtttctgttccgccagcgcagctccgggctcagtgaggcggcctcgggtggcgggcagcacgggctcttcgccggctcggcgagcagcctgcatgctccagctggcatccccga

SEQ ID NO: 139323 - DNA, 4792 bp, Homo sapiens
cagcggacttagagcgcgagggagagaggtggcggccagggaaaggggcgacgccccgcaacggccgctcgaaaaagaagcgctgtcagtgaccatccacccctagccctccccgtcccgtggcgcctttgccgagttctaacttcccgggcagactgctctgcggtctcaggaactaattgggaccttctcgcgcccaggaacaaactggcgccgcctctttttgtctccctttctgggttaccgtgaagggactccgaatgtgttgagagcatattgcttacaagcgacttagctctcggcacacattcgtggaaggcaaccatacaaatgctaatgaaaactaactttcggttacttccgcttttttttacacttgattggcacatctcctaattaaatgactgatacttttgtcaaactatttttatttggagttccaggttcaattcagtcctccgggaggaaagctaaagcagtttcgtggtttgttcagaacatcttgtaaaactgtctggagccccctggatcgatcgatctatctatctatctatctatctatctatctatctatctatctatatttttttcctcaaacattaactacgactacccaggctttttaatatcgggcttagccaaaccgctgcatttgaaagaggcaaataaaaaggtacaaagaggctgaacgggattgtcctgtccggggcccattgtcccgccgggctcggttacattgctgaggtggtggcggaacgtggccgcgcattgggagccctgggtcgggtagggtggaaacacaacttaggggaaacttcggaggagccaggggctttccctccttgcaagaacaaagacatggtcaggttttgggccggccccgccccacccccacccccaccccgaccaccactcccaaacccagcgggctcaacctacgctcttcatttctctccagggaaaatagatgcagcagcagcccccagtccgcgctccctttccgggaagaccgccgggagctcagtctcctgctgcttgcctctgagaaactccggcgctgaccgtattttaccccccttgggtttttgccttttgcaggtgagaaacctttcaaatgtgaatttgaaggctgtgacagacgctttgccaacagcagcgaccgtaagaagcacatgcatgtgcatacctcggacaagccctatatctgcaaagtgtgcgacaagtcctacacgcacccgagctccctgcgcaaacacatgaaggtaattacctctttattagcggtcggcggtttgtaaacactcggcccgacgccgggccgcggaacggaagcgcccgcgctgccaaccctctgtcttccacgttaaatccgatttgctccagcagtgacaccttgaacccattttggggaccgggcgggggtgggggtgagggggtgggcgggagtgagcaaagttgggagggggaggaagcggagggaacaatcggttgtttactgggaagctctagccgagctcgcctgggcttgcggggctgccgtggccgcctcttcccgactcagcccgcggtgggaaccgagagtagccgcgccgaacccgagggtgggtggttcattcgctctttggcttcggataaaacaatagggccgaggagtgcaatctgattcccacacatttgtctgcgacttcgcagcgctcagggcccctgtgccaccttctctgtacctgctttctcaagccgaaacgggcttggtgaaacctgggcccggagttagtattttataggacctcacagtgtactgcttacctcactccatccgcggagaaagcatttttgaagtggcatgaccaaaacggaatgctttattccttttccgtaacaccagtcttaggagcaaaactggtttttggcgaacatctccgggttttctagacatcggtaatacggattttttttaagcagcatttttcttttaagtgggtcactgggcggtcttgttgttacagtgctcgaattctgctcttgtttttgcttgcacattgccagttggaattatattcattataatatatacatgttaattttaggttcatgaatctcaagggtcagattcctcccctgctgccagttcaggctatgaatcttccactccacccgctatagcttctgcaaacagtaaagataccactaaaaccccttctgcagttcaaactagcaccagccacaaccctggacttcctcctaattttaacgaatggtacgtctgaggacaaacacaaaccctgttaattatagaatggaccaaatacatttttaaaagaaaactgagaccaatcagatggaaatggagttttaaggcaagaggccatatatagggctacatcttgttaattgcaattgtccaggaaggttttgggcaagatccaaaagtagccatgcccttttctcaggatagaaaatatgttttggcatttgaagcattttttacaaaatctttacactactttttcttccccttcctcttgctctctgcacaccccattcttaaactcctccaattcattttaacacttgtcctgtttcttgagaggaagttatagaaggcttgttggtggtggtgatgttaaactgatggaaattctttttcgccttagtggtgattgtttaaactctcacagtcttaaaccgtgccaaagtcctgttatgtcttgaacttttcctcaaagcattacacttgtgaatgtatttttgtctaatagggtcgaaactgttgttcagtattttttcaggctgaggatgtgatgttactctacacattgtgacgtttagtatacagttgccttttgtaataactttttttttgtaaatacatatccattgatgccatatttatcgtttgtaatttaattattgctacaagtgccgggaactgaacaatatttatggataaatgttttctaacaaattctgtacagcttttgattataactgctttagcattaaaaattgttttgaaagaagaacacaatttacaattttggaaccactgactcctttctcttgttttgtaacagccttcttctacaaagaggagatgtgagcaaattaaatcttgtttgttggtatttataactcactcagatcccttttttaattgttaaattatttttctattacagtataaattccttacagtgtcagtttccatctgggaagactctcctttctttatctctatctcagatggttgtttaactgcgagtttaaatgtgtttgtcctggattttcggcatgcaaatcaaatattactgatcaattcagttagtggccatgacatctcaatcttgtacttcaaagactgagaagctggatttaatcatccctgccctacatatataaacataaggtaacctactgaattttatgtcccttagttctttattaccttacataaaaatgaaaattgcggcaggatgcatgtctgtctgttctatctagagatcacccatatacctatatatgtttgtatctatgacttatctaatctgcctatcaatctatctagtagctatctatatattttcaaaagatagcttatgtctaaaacagtggtgatgagtaaggccagttgagcattgcttacttatggttaaagtgcttcttaaaagaaccatagtccatttacaattttggaaggcaaaggctgatttgtttgctgtatatagttcaattcataattatcgcaattatccataacatttatatagcggtgtaataactgcagcagttctgaaatgatgctatgggaaaaaaattgcaaaatatgtatttttaaagttcatgatttgtaggcaaagatgttaagagcattgtttccattaaaatcaataacaatgaaaaacggttgtttgctttgtgataaaatgttaacaatccatttaatcttcagtgaagcaactcatttggacaaacagttcttttacagtggttatatggaaaagaaattgattgctattttggggggctggagtgggtagagtattgagaccttttttattagggtgctgtttgttattgagagcccaatctctgcatgaataacagaaaggtggacataaggaattgtaaagtatttagaatgtattgaataggcttaagtacctcctttaaggggcaatgctctaggtttttggtggcagtcaatttggtattatatatgatcattttcaattctagaattttgtttattgttctttttgaagaaataaagtcttggcacatcttatttatgttataacatttttgtatttggtgcctgattttttttcatgttcaaataaatcaatctaaaattgaaatgcttacagaacttctgatgattaaaagaaactttgattctgtgaatgcggttgaagcagtctatttaagttatctactgatctttgtcaacagacaattagttattgacagtttctaattgcaaattgctttggaggctattttttgttagtggagaataatggggtcttttgcattttcttccaccaatatccaagcctgaatgccatgaacagagattgggatgactacacatgtgatgagcaggtaacctggtcagtctatcactcccaacccagacattccgatcttgaccttgacattgagggtgctggaccagattcctatttcaggctttttccttcacctcaaaccagagaccattttaaatgctcagcaagttctcagaaagtatatattcataagactggctctaagtgtgttccattgtgaa

SEQ ID NO: 139324 - DNA, 1118 bp, Homo sapiens
accaatattaggagaatataaaagttttgcccctgtacatgattacctctaatttgggtgtagcatggtatttctcaaaatcacgtcctccacccttgtcatctgtggtaaagaaaactccttattttgatagaaagcttttcacagatttcccccctataatctggctctgggagtgcacatttacactcttgaatattcagtaaacaaccttagagagtaagtaccccccccaaaaaaaaaaaaaaaaaaaaaaaccaaacaaaccaaaatcatcaatgctcaagcccgaggcatgggccaggctcttaggaatcaacttgttactttccctcttgcaccttgtaagatctttgttcaaagtccctttttcaaaatgagtgattttgcataagattcccactgttaggcaaaagggaggtggctatttccacgcaagacagaagtttggccttcatccagctttagaaggttaaagatcaggacagggtccacgctaagcaggccggtcgatctaaattactaaagttggacatgagtgagcaaagacctccgctcacaaagcatcccaggaaagttggagtgttcaggacttcctcgctcctcccccttctcccttctccccgcctgatgtctctgcctcttcgccctggctctctctcccccttcttaaaaaactccctaaaacagaggagcaaagtcgaagggcctcttaacatgtaagtttgtggaagaatcgccagcagcgtgcccatcgcctgaaaagagaggttatcttggcacctagactgctttcctctcacaggtttctgtccctcgagtcccaagcctccagtggatccttggccggggccggggcggaggcggcgaggccaggcgtttcggaagtcggggctccagctcagctgtcctcgggcccctcgtcggggctcccagggtccctgtccacacaccaagttcttgcaagtctctgtcgaggctcgggcggggggggaagggacctcatttcctagggtcaattctctcgcggtctctgcccgctgaccctttgacctccacctacagggcccttggcggccgtaagccggcggtcgcccgggctccgaggacgcttcgcg

SEQ ID NO: 139325 - DNA, 1047 bp, Homo sapiens
gagtgaagaaagggaatcaactggcatatctgttggtatttgtaaggcaatgcctttgtaaggcaccatcttctcttttctgaaccactctctccctgctctttttctattttgctctgaaaatctctctcttatctcagtttaaagctttggtctccaagtcagatgcaaagtaaaccaaccaaatctgcccagttacataataatgaaagagtgagggaaaagtatttcagcagtaatcaattatttttcagtcccaaaaagtatacccttgacttcatttttatatttttaacactaaccaattatttttttactatccaaaccaaaaactgtaccctcaactttgtgtttgtatttttgtcccatgtactctcaaaacatgcacatttcctgcaaacagcacgttaatttatatcaagccttttcgatcttgaggacaaagtacaataatgtttacataaataatgtttgcaaaaaagaattgtataaaaccagaaagaaaaccctatttttgtcttggcttctggcttttttagatcttaaaaaaaagagttaccatttcctgagaacttgttgagtgcattatttacttaaatgtcaagtttgctaaatccagctcatctaataaatgtagctcaacctgtaacatttttagttgtgtggttcctaattttaggctaattctgtaaatcttccaatttcttataccgcttttagtactgagttttgtgttttccagtatcagactttctactaaaggtgtcagaacaattttaatgaagcaaataatgaaataaatataataaatttgcaacaaattgcactaaatgtcatttaacaccaacctgatgttagaacacaggtatgacaaaccaagacctttctaatagctttagaacacatctttaaattcttacagattaagaatgcagttgaaaagccacctttccagtctgctgttatgaaatcttgtcgcttggattctggagaggattagggaggtagctgattgctaatattgcaaactggcccccttcttagtgg

SEQ ID NO: 139326 - DNA, 1038 bp, Homo sapiens
ggatttagtctaatggctacaactctagcccattattacatggatcattttagccacccattcttgcttatctgtaatttccttcatggatagtgagaaacctgactcccagcatctactgtccattaatgcagggttgtgtgtgggcgtttagggatttatctcaaagaagagagcctctgagtttgtaatatgagccttttctctgtttgttgtgcctcccccatcaagtgatcttgattctcaggaaaccttcctctacttctaccctaggaattgctcttgtctctgggttttaaacaacccatgaagttgaggtggaaaagaatgcctatttgcctatagctgtggttgtctgcttctgatgacagctgggcttgagtgctgcccagatattaccctgcatcttctgactggttctgttcctaattgttttctactgtgcagtggtgccaggatcaggaaaaaccttcccagaagatgttggtgagactgaaaagtctaactggaaagcttatttccagtcattcctctctctgtgatgggtaggtttagactcaaccccacctccaccctcagcaatgggatccatccactttctatgtctctagggatcccccacagttttcttgttgcattctgggatctcacaaacttccttccctcaacacatacacatttctagatcatctccagggttgacttcagaaggggccaacagcctgtgtaagttctccatcatgtcatgaactggaaggtcaactgccaactttaatttcattgctataagtggttattgtaaaagaaaagaaacctcagaaattgtttatgagaaactcctaagttacaaagtcagaaccagtgacctgcttgtttattgtgtttcattggcacatacttcaggttgtgctatgaatgactgactaatgcttacactgtgaggcatactctaataacaatacattgttctttattatccctaaaaatattgaatctacaaatctgtactttttaaagagattggatctcaccatattg

SEQ ID NO: 139327 - DNA, 1032 bp, Homo sapiens
agactggggtttgaatccagactgtaccataaactggctgggtgatttgggacaagtcattcaatttccttcagcctctctttccttatctataaaacgaagatagatgcatgtacttcataaggctgatttttttaaatttttattttcatttttatttatttatttattttgagatggagtctcactctgtcacccaggctggagtgcagtggcgtgatctctgctcaccgcaacctccacctcctgggttcaatcgattctcctgcctcagcctcccgagtagctgggattacaggcatgtgccaccacacctggctaattttgtatttttagtagagacgtcaccatgttggccaggctggtctcaaactcctgaactcaggtgatctgcctgccttggcctcccaaagtgctggaattacaggctctagccacgtgcctggaggctgattgtaaaattaattgcaatagcaaggagctagtacagtgccagaagcatagtaggtatatcataaatgtttgtctcatttatattaactctctggattaatgaaatttttttaaagcttccaatgtaatacactgctaataaaatgtagaagaaaatattggtttaccagaagtataatgtattagtcagggttctcttagaggacagaactaacaggatatatatatatatatatatatatatatatatatatatatatgtatatgtatatatatatttatgtatatgtgtatatatatatgtgtgtgtatatatatatatatctcatttcagaatggtgtgtgtactttaaattctatccttcctttagtatatttctgacacatgtgtctcatggtttggaacatatatatatgtatatatattctattctatatatatatatcctattttatatatatatataaaggggagtttattaagtattaactaacatgatcacaaggtcccacaataggctttctgcaagctgaggagtgaggagagccagtctgagtcccaaaactgaagaacttgga

SEQ ID NO: 139328 - DNA, 1049 bp, Homo sapiens
cggcaagccgtcaagatgatttggcagattcagaagagcctgataaattcctcatagcaagtatcaagggagaggtacctttgagttttcagccttatgttacagatgctctgaatggtgagcttccaaagaaacttttggagtatctaatatttctgagaaaagcattctggttcccattttacagcaacacagaggcagccttagcaactaatggattttacatctggaaaaggagaaaagaacaaaatatttggccaatgactaaaatatttccacatcatctagccttcaaaagatcacctatgagacacttcagttttagaactgtagaagttaaataaagtaagtaattaactcaaactctactactttgggaattcttttcaatattctgcctagcatagattacgccagggaaaatgtggagttgaatcaggtggctcacataggcttgccactggatctgcttttagaaagagagagagggaattaatttaattttagaaaggtctctcagggctccagaaacagtggagtagaatggtctagcacttttgttcttttctaaaggattttaatgtattttctcttctgagatccaaagggccctgaaatgcctttcttgatcaccctttaaatctttgtgctgcttttttcttctaggctcccagagaatgaagatcacaatagagtaagcatggaacacgacgatttatattgatgactctctctctctctctctatctatctatctgtgtgtgtgtgtgtgtgtgttaaggagcaaaactgtattgaaataatttatgtgcaattttctaaccactgggattcagttgcactaccaatcctcattcaatgtggattggagaatagtgtgaccgttccttctcagggtattattcattttcccttcaacaatttttggctatgaagtaggagggtcccagatggattaccatctggggaccagcccaagaagcagaaagatagtcgggaagacatttttgacattaacaatgtccctgtggaggctcttaacctgtgac

SEQ ID NO: 139329 - DNA, 1046 bp, Homo sapiens
tgatgacttctattttgtcaatgagttaagtagcaaggttacagctgaggggggtaggatgtaggaataggcatgaaatagtcgtcttgaaaagtaagaaggagatatttctaaagtgatacggtagggtttctgggcaatgtttgaggggtcattagaggtcttagatcaggaattttgaagaaaacttgttgcccagagtaggggggattctctgtcctaagatacttttagttatttttctgtccattgctctcaaaggaactttttgttttaaacctaaggcctggtgtccttgaagctacttcaggtgatccaaaaatcccctgaacttacatgcaaaaaattatgcatatgtgtattttccagagaatgggtccttagctctcattagattatcaaagaagtgtctgacccccaaaagtttaagaaccactgttgaaatgcttgccctcctaattagtacagccctttaggactgcaccacagtcgctctccttcctagccagtattctcactggcccgtgaattacctaatatggaggcgtgttaggtaactcagcaactaaacccctagtatgaacttcaggtaaccctacctaatgtggtcttttcacaccaccaactctgcctctcttacccccagccattcaccacaatgactacagagagaggagacagtgtcattgcttaacaatgcaacgaacactgtcactacaagtaaggctattcctgcctttatttaatacccctcttattagtacacattgatgctgtttctcatccttggatatgctagttcaaagagggtgtgcatataaagaaatttccggccgggcgcggtggcacacgcctgtaatcccagcactttaggaggccgaggcgggcggatcacgaggtcgggagatcgagaccatcctggctaacaccgtgaaaccccgtctctactaaaaatacaaaaaattagccgtgcgtggtggtgggcgcctgtagtcccagctactcgggaggctgaggcaggagaatggcgtgaacccgggaggcgg

SEQ ID NO: 139330 - DNA, 1034 bp, Homo sapiens
gaaggacctccttttgacaagccaacctatgaagaatggctggctaacaagtacttgcttgtttagccatcagtttaagaagggtggaatagttggaggtttagctcttttggaggtttacagccctttttagaggctgtcccttgctattcctctctccttgcaaggttcagaaattcctgtcttttgggttcatatggctgaggccaatcaaatgctttcatcagcttgccattggatgttgagtgatatattgccaccagttaaaatttgacctactcaatgaccctcttgcaaacattaattgtgcagaacatccttctcctccaacaagagtatcttcttgaaaaggccactcatttacttaaggccagagttagcccaactcatccaaatttgttacaaagcttaccttgtactacttcatccagggattcctggagaaaagaatcacataggcctaacataaaggttagaaagagattattttcctcagcgactttgcaaacgattactaaaaagggctttctgaacttctatgagatacttatttaccataacaaaaacacagccctaatcatcagagaatagaaagatgtataactaaggctttactttagctgtgatggattttgcacaaaacctttgaattgccatgggaaaggaacggcaaattttaatgtgcagagaaatattaaaacagcataagcaatgatggccgtctggttttcaaactggttgatggataaagataggctctttttatttctgcagaaaccaaaccacattaaacaagtatttcttatcatggagccaattgtatgcaatattacagattttctttaaagcttctagttaatcttgttgtgtgcctttggaggtattaggaaggcattgtcctgagatgagtgaatatctaaaaggagactttttctttttaatcaaagtacagaagctgcaaaacaagggaaaattaagaattgtctttaaatttaactaagctaatccagctagctacagagatattctttcta

SEQ ID NO: 139331 - DNA, 1034 bp, Homo sapiens
aatggcatcagtaaagcgcaaaggcacacatggttctgtggtgaatgacactggaagatgacgctggaaggcatggtagtgactgaattgtggagaatttttaaatgttacatcaagttgtttgttgtttttactataggcaaggtgaaatcatcaaaatttcccaaggaagggaactttgctttaggaaagcaaacctgccagctgaagagaagaaaccagttaggatgttatgacagcagtccagtgaagaggtaataaggcgcaaagtagagcagtggcattgggaatggaaggtgaaggtcatggatcacggactagagggcacaggaatgaaatgaaaggccctctgaagtgttaagtgagcaactgccaggatggtggattccagttactaagacagggaacacaggaaaagtagaggaagtgtggccctgtgcttcaaatattattcttccctgttttctgtattgaaaagctcggctaaaatgataccctctctgtgaatccctccctagtccctcagtcagaattaagtctggctttttctgttttcatacagcacctcctgtaagcctccctttctttccttatggtagcacacattgtatctatgacatttgtgtacatgcttgatacctacaaatatatgataagctgtctgaagccacatattacttacctatgaatatttagcaccgatcaactacataatggatccttagaaaatgtgtattaaatgaatgtatgaatgctgctatcacacaagacattaaatgcagcccatttttgggacctgacttagaatatgcaatgatcccatctcaccattctggagtcagccatacattgtttatgtggctatttggtatcatttgccttgatcatatgcatttttcaccagatatattttcaaaatggtttgattctttatgaaaggaaaatccattctccaatgatgacttttttccgtacagtgatttaattcccaaagaatttcagcaacgttctatgtacttgtcctcatcactaaa

SEQ ID NO: 139332 - DNA, 1041 bp, Homo sapiens
taagcaggctgcagcatcataataaatgatacataatatctgcctttaaaatgcctgtagtggttaagagggagggctctgacattacatggatttgaaacacaattcaaatgcttataaggtttatgatttggggcaaaggaattattaatccatctgtcctttagtttcctcatctataaaatggaggtaatagtagtatagacctcatagggttcttaagaggattaaatggaatgataatacatgcacagcattttacagtgttaagttcattaagttaacaaatgcttcatattatttgccgttacagtccatataataacatgctgccttcaggccaatatatataagcctataattcttggaagactatggaaatcctatcatatattaaattgtcattttttttaagactaagaaaaatttatgtaaagtccaaaagtacagctgtttacaggggacgaactgatccacaaggccacagtctaccctcatcagttagtgtccatcactgaagtggaataactcaaaaggaaaaggtaactcaacgagccatccatttcccacatagattcacaacagaagacagaaaatatggagtggaatgttgaatcagctgctgttgggagaccctggtctgcactctatctgtattcttactgaagggagtgcagggcagggtttcccatacagagggcacagactaccaccgtatggcaaatgttgactggaactcaacttcaaagccatttcacctggaatcttaccccaccaccccaatgcttcatgaaaattcaactgatcctcttctatgaagaaactcaatcctgataagtctctttagtagttattgaaatgtctttgtaactctcttatagtcaggttcagtaagaatgttaagtttctaattgagcttttctttctgaacagttattttgtgtatgtttattttctgtttaccaatgtaatatatgttctttgcagaaaaattggaaaatacaaaaaggtatctacaaagtcccccaaccaagagaaaac

SEQ ID NO: 139333 - DNA, 1043 bp, Homo sapiens
ggggctgcaaggaggctgtcgcgctgttccggagggtgcctgcggcggctgaattcctgtgctgcgactgtgccgcgcccagagcagcagcaacagcgaagatgcgaggccattacctgtttgatccctgtcggaaacctggcacgggccaacttttcccgattatcacgccaagaagttgcaaggactagtcgaagactcggaggggccagggcgagggcgcgctcccccgcgcgctgcctcgtccctcctccgtccggccgcccgagctcccggcctctctcccgcccgcgctcactccctccgcccgcctccctcctctggcccccatcagaagggcaacagggcgagggggtccggcgaaattcggaccggagcagctggacatgcacggtgtccgccgggcgcaggggccgaccacacgcagtcgcgcagttcagcatccgcgtgccagtctcgcccgcgatcccgggcccggggctgtggcgtcgactccgacccaggcagccagcagcccgcgcgggagccggaccgccgccggaggagctcggacggcatgctgagccccctccttggctgaagcccgagtgcggagaagcccgggcaaacgcaggctaaggagaccaaagcggcgaagtcgcgagacagcggacaagcagcggaggagaaggaggaggaggcgaacccagagaggggcagcaaaagaagcggtggtggtgggcgtcgtggccatggcggcggctatcgccagctcgctcatccgtcagaagaggcaagcccgcgagcgcgagaaatccaacgcctgcaagtgtgtcagcagccccagcaaaggcaagaccagctgcgacaaaaacaagttaaatgtcttttcccgggtcaaactcttcggctccaagaagaggcgcagaagaagaccaggtcggaaagggcttttgctttcttttccccatactttacgagtgaggtgggggcggtggggagcaggtatgtagcataggtgagtttgttggtggcccatcttgtgcagaagaggccacctagcc

SEQ ID NO: 139334 - DNA, 1101 bp, Homo sapiens
acaacaagatacttgaagaacacagtatacaaggagtcggcataatgagaatttccccagttgtatttttcttgtaatattgacgttgtttttccccctgttgtgaactaaagagatagaaaatacctttgtgtctagttgaaaatggattcttaattaactgtccagagatttgttgttagaggtaaaattctgggaagggttctttgtatggacaggaagaattagctctgtagcaagcataaaaagggcccatttcttcctaatggcttttccaaggaagtggggaaggagagaaaaaccgaaaaggacattctcttattgctcaaatgaccagatttcttggacccagaactgtagctcatacacagctaacctagggtcaaggtttgtaggctgcctctaaggcatccctttctttgccaaattgttatgcagatgtgatgtgttaaaaacacactccagccctggttgtttggagggcatctttcctaatggaggtgatacaatgtgcttattgagtcagcaggcactttgttccagagtagacagtaatgcaggagtaggaacataagatatggaggctaagttctgtcatttattatgtatatgacctggggcaaatggttcaccctcagcctctgtttgcttacctaagacatggggagaataataataccaacttccaaggcttgttgtatggatcaaatgagataatccatggaaaacccatctccccatgcgagacatatccttacatagtggctcaataaaagatagatgagcacgacagcattttgtaggacaaggaaaggctgggactatagactctgtttatttgaaaataatgccaatgagaggtctttttctcttgggccagtaagtctcactcagggaagaattctgacacaagtacatagactgcacatttaagctctatctggtgctcttccagattatggccttggttttgaggaactccaggaataaggggacttgatcatagacacactagtggagagggagcatcaggtgcctgtagatcagcagaaatgctacttttttttcagaggaatgagatgccatacatacaacctaatc

SEQ ID NO: 139335 - DNA, 1035 bp, Homo sapiens
aggacctctacttgcaaatatttctttttgtgatatgtggatgatgacatatcaaccatccaagatggtgctggatttgaacctttttctaatagcagtgggaagtcattaaaggattttaagcctagggtaacatgattcaattttcagttacatgcgatatgtggatgatgacaaccaccaccaccacaatgaaagtaagaaaaaactgatcagtgctttttctgttcttttcttatgttattgcatttaattctcacaacaacttttgagacaggcattaattttactcttctacagatgaggaggaaaccaaggctccaagaaataacaccacttgccaaagtcatatggcttgaaagtgaccaagccaggaattgaattcaggcaggctggtggcctttcttaaccattacattgtacccagaaattgaaaaccactttttcccccaaactgttaagaattagagagatttggtactctgccagtactacttactggcagattttgaaaagccgtgtacttaattaaagttttcctgaagagagtactttgctattctctgaaagtttacaccttccctatttttattgtctgtgatgatgccatttatgtttttatgtggtggtatttttatctttttctttctgttagctgtcatttttacctatagaacctgtggccaattatctgtgccattttctcacttgacaactaaaatattgacaataaacatcagtcattgcttgcagcttagaaaaaaatgcagtgagacacatttatcataactgagttttggaaactagctgtctttatattcaggtgacagacacacttgtaaacaactgatgtttacagcaccaacttagatctcacaggaggaatggggtttttttcacttgcctatgtattcttcaggcagaatgtgtaccttaagtgtttgagcccggcaatgtcttcagtctgcctgagctccaaggttctctttttcggcttcttaggctaatcagtgtgtgggtcctagggcacacaaa

SEQ ID NO: 139336 - DNA, 1343 bp, Homo sapiens
aaacatataaaagagcaacacaatgtattccatacacccttcttccctgccaaaacaagaagctggaatgacctgctcttttggcttcacttggtcaagttgtaaactgagcaataatgggtgctgcttcccttgtagagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagtttattaatgaattaagtcaaaattacggctgcaaaatggctaaggtcaagtaaagcacaacattatgatttaatatgcttttgttgaaaccacagcttttgtgcccattgttttaacttgtgtgaaacaatacaaagcccagaaattcttttcggggcatgagtaaattttgttcagggctactgtctgtatgtgcccagataaaattttcatgagagtagtttacaaaagccgtatttaaaagttaatattttcacactttttttctggatttctgcttataattaatgtaacttaaattagttgtgctctgctattttctgtatatttcatgttgtaattctttttttcaaataaaaattaattcttcaggttagataaacttgttctgcctttttcgttccccatcacatactgcttcatgtctgtctgttcctgcaaagctgctgcagctaccacatttaccagtgaagaaaagagttaattcttcatgttgcagagcaggcagttatgcaagtggttttgcaatcaagtttgtaatataattttttaaaacaactttacagtctccaagcaaatatagatccctagcagactgcaggaagagaggctcagaagacctcctgattagaaatggagatgtcattcagcttctccatgggaatgctgagggtcaatggtaggtgtgtttgcaaagcctgtgatgatctccagctggggcacatagatagctaatcaaatgttctgctttatctgtatctttgttatacagtctccaaaagcagaaatatcacagcgatggctttcattttcattgcttcagcactgcctataaagctcactgaaa

SEQ ID NO: 139337 - DNA, 1630 bp, Homo sapiens
aggctctcatgtcttgcatatgcaggacactctgatgggcactagagagtattggttgtcaaagtgtggtccctggaccactagaatcaacatcacctggaaacttttacagaagacaaattctcttgctctattcagaccttctggatcagaaactctgggaacaaggcccagccacttgagttttaacaggctctctctgtgattttgatgcatggtcaagtttgggaacccctgctataaaggatatagtgatgaataaaacatatatactggcttcaaggaatgcgcatttcacttaccgttggtttaatgaatagagaagagtcattaacagccgaaatatttattcttcctctgtgaatggttttatttgaagtgattttaaatactttatttaattcaacaaatattgacatagcatgatctgcattccaggagttatgcaaagtgctaggcatatagtctaactaggatacactcagctgccatcctcatgaagctaggagaatagaaagatagttaaacaagcaattaaaagtaaatttggcgagtgttacagcagggaagtacgaagtgctgtagaagcatacatgaggatcacctaaacaactctaggatcaacagcatagacttctttggagaaatgcctaacagagtgcctgatactcaacactttaatatgatgatccttaatatggaagagttctctactggttgaggagaaaaaggtaatgatagccttgtagagtttccatttatccaattaaaggtcacttccctcaggtcatctatgctgtggcccccaaagaagtaaggagagagcatagtactaatgccttcatttgacaggtgaggaaaccaagttagaaaaagatgacaatgacttttcccaggttgcatgaatagtttaatgtggccaggatgagatctgttaatttgctgcttacattagattggttaatccatttttttaaattcaactttttaaaggattacagctagttttacttctcaccttgtggtaaattagcaccatgaagtaactgccacattccacacttttcttatagtttggactgaggcatcacaatctgcagaaatctctgaagaacctgcggaatggtcaagcaactatttctaccctacttatgatgaaaatgaagaagaaaataggcccctcatggttagtaataatatagtaaattaaaattattgaggcagttttactgatgaaatataggtggagcacataggggcaatcttttgtcagcatccttgaggccattaggagtaagccattgctaaaatagttgaaataaatcttattatgaacatcaggaagcacttctgtctttaagtagaacctgtttgacctatacatagagcttctgctgatgttgatgaaatagatagtcaatctttccaaatctctaaaatcccagttttatctttagtagagcttcaccactgtgttttccatccaggcatgtgaaataaaatcagagaacaaaggggcttcaaatacactttaaaaaccagtttggattccagattagaaaataaaggaaataagcattatacattaaaaacgatttaataacatctgggggatatattttagtgtgtt

SEQ ID NO: 139338 - DNA, 1092 bp, Homo sapiens
cacctccctcccgctttttttttaatctttaggcttctaatgtagatgtgaagatgacgtggctaaaagaaataagaaatattttgttgaagcagcaggaacttttgacaggtaaattcaagcctgcattcttcagaacaagaagtatagtaacagcttattgactcagatttttaaattatttttccagagaatggggctgatatttactttatactattacaatgagaagatttgttaatttaattagtaggagattgagattcagaggattgtttaaactattttgaagaatgaactttacactagaaaatgaacccttgtgcttaagaagcagttgagaagcaacacagtgaactgattgtggtaatccccagtcctttccatgaggtgactctgcttaatatctcgagtaatcattgctctataatgatggaatgggagccagttctacttctaaacttgaacttcttgaataaaatattatatggtccagacctttccaaattcaaacttgagactggccttccctctgattatttcaagtctgtgaagcttaagtctaatggcaaggatgcgtgtgtgtgtgtgtgtgtgtgtgtgagagagagaaagtcattggccttcaaggaagtaagaagtgtgacttctgaatgataatatgctttgttttatttctcagttaaaaaaagaaagcaacaggatcaattaacagaacgggataagtttcagatttctcttcagcagaatgatgagtaagtgattattctttaagaaataccactcctgcaatcttttgttttctgtatgtaacatgaagcaatgtaattaaagtatctctgacaagaaccatccaccaatttagcaataactcatcaaattccataaacatcattttctgaggtccagccttatactggaggctgatagttcttaatagttatcccttgggttgatttctaaacatgattgaaaatgctttatttttaatatatcattggaagaattacatgtaggctgacaggaaaggaggctgtgctcataagctttttttttcaaagtatttttggtcacctttgatctgactggaaa

SEQ ID NO: 139339 - DNA, 1869 bp, Homo sapiens
aataggtgttctttctattttatagttgaggaaactgaagtttagaaaagttaagcaacttgcaccaagacacatagctagtgaatggtagagatgtattccaatccagacctctctaacttcaaagcctgtgggccttccagcttatcatgttattaagacaaaaccatgtaatgaaacaaaattaatttttaaaaatattgaatatgagattactattcatcttaaattgtgatatttgagcagaagtaggttagttggaatgatggagtgagaatataaagatagtttgggacattgtgaaaataacttcttactacgttcagggtggatgttacaggttctttcattaatatgttatgttaaattacatttctaagcataagtgcttttcttctccttggtatggcgatctccctagcactatctttaatgcttattagctctaataagggccatttggggggctcataactagaacagagagtgagatactcctttagataattaggttaagaattgaaagaaaagaggaaggcagaaaggaactaaaagaatgtttgtgcaaaggagtgagattgcccaaaatgcaattagccaagctgttagcagaaaatgatgaaagaaaatggaagagtttatgacttgcacaatcacgctgaggaaaagaaaaaattgtggtaaggaataaggaagagatattgtgtacagaagtttcactgggtacaaaaagacaacaatgtcccattacatattattattattattttttttttagaaaggccaagggattggtggaaaatagagagatccttgtgtacctggctggttctctcctgtcccatgaattagatgtttataacttgtaggacttctatcaaaataaattataatttgtaggattaagtggtctgtcaaatgattattctaaataactatttaaattaattttcagtggcttttctttattgatgtttaatgacttctgtgtttgactcaataatttgttttaatagtgtactattaatttataacataattagatcttagatgggctacttggatgttcagatttataacatttgtgtcaaccactgaaatgaagcgtgcaatctgaactataaagtgcatagttcaatgaaaacatttaaatactctcgtctatgattgtaattactatttcatattcatttaatataacatgtatttttctgcccaagagaaattctgtttcacttagaatatgatagggtagatttaatgtaatttcatattcaaaataaaatgctcatgaaaattttgacttatttattatagatggatgaagttggaatcactgaatatgtaaaaggtgataaccgcaagtttgaaatctggtatggtgaaaaggaagaagtttatattgtccaggttggtcatttgaaaattcttctagaaacccaaacctgcattgaaatacaaaagcccgaatttataaacaaaaataattttggtcgcatttcaaaatttccacccctttcatgtaggtcagttaaatattatttgaatattctttgtgatgtatttaaatgttttctagtagttacattgagatatgcctgtggtgttctctagggcttcaagttttcacaactacataagagacttatcaactagagctgacagcttggcaggtacttctctgtccccatcaaatttccaagttatggaattataatagttctgagttcctcttatgctaagcattctaggggtacctgattatgagacatggggatgtgacagttcagacttgctttctgcttctaaagaacatggttaaagccctggccagttgtatagggtccaacatgtttcagggaagggaag

SEQ ID NO: 139340 - DNA, 2440 bp, Homo sapiens
cagtttccaaattttgcggaagttttccccttgcttatcttcttcataactttgtgattttgcctagtaaaataacttttccatcattttagttggttgtcatgagtgaggagatctaaacgcatgtatcaagttggtgcaaaagttactgtggtttttgccactgaaagtaatggcaaaaaccacaatcacttttgcaccaacctaatagcagtcccccatctttaagtctcatttgaattagattgtatgttggattttacccatattcagaggagagccatggttcttattcaggcgtatttttccccaatccctttgtgttctatactttctctatgcacatttcatcctaaatatctgcatcttgccctaactatgggcccctacaatgttcccggaacccaacatcatgacccttatatttatagtggcaatgggccaattactgaagtatagcaccagttgatgatggctttttcttgttatattaaaaattttgttctcatatccagtctgatttatattcagcacaaccaatttcttttctgagccttggcttgtagagcttggtctttcgtgaattttcttgaatatattaaagaacgttttaatcatgttaatctatagtcattccctgctttcacaccttttaagcattccacatcaatatgaatttatatttgaaaacttttaaatctttgaaatgttgaaattgtttacctctccaatccttgaaatagtgtttatggtagtttttcagatatattgtgtcttataatttctgtactataacagtgatttttccaataaatattctttgagatgtaagaaacattggggcattaggtttaatcaatgaacacttggcattttcacaggtacatgtcttaatttaattttattgatatttatcttttaatgacaggaatgtcaaagaaagttaaaacacagacttagactggattcctatttactcaaaccagtgcaacgaatcactaaatatcagttattgttgaaggtaattatatgaagcatttgtttgtttctttactttttgagtcagatatgacagagccattaaaaaggaaatagtttactaggaagcactagaaataggtaggctcaatgactgggaaggctggatttggcagaattttgcagtgtgctccatcaattcactgtggctacaaatgccataggcatagatatcaggctgagaatatctgggatcttagctatttaatttttcatacaagttgtgttgatttccgcacaatgttttactgaagaactttaaatattagtaagaagaactaaacaaagcaaatatttcttatagttttgaggctgcatttcataggggccttcctaatgaaaaatgcgaatggcactcccctagtataatgcgaaaggattgctagaatcttgtgttaagtataaatacaatatggcttgttttaaagtgaattttcataatattctatgctatatgcattatgagtgcatcatggctaaaacaaattactgtatgtagaggacaaaagaaccctacatgtaatggctttaaaaattgatctctgatgtgtcttaatagctattatacttcaactccagaagcattaaatgtcctttgttttatactattcagtcactattctacttcctctattttgacagccattaaaaatattactgcagcaaagggcatgtaaaaggaattactccaaaatgtgacattatatttggattccagcttgaaagcatgttagccaaaaacttattcatttcaaccagatattaatatctgcctaatattaattcctgatttctaattacaggagctattaaaatatagcaaagactgtgaaggatctgctctgttgaagaaggcactcgatgcaatgctggatttactgaagtcagttaatgattctatgcatcagattgcaataaatggctatattgtaagcacattttaataattgttggaattttagagggtcggcatctcaacatcccttttcccctcctggaaccaattgagaaataacgtataagaatcagataactggagatcaaaatgttgatgttactactgataatgctaagtggagaattggcttcagatcagcagccaaatggatttatgagatcccccttgtccccaacagtcttcccccaatcccagacctgggagatcctgcttaaggaatgtttgagtcagctaagaaaacgtattgctccataattgctgcttgcccctgtagataggaatagataggaaagaaaagaatcaaatctttagcacttgtgtagccttttaacaggttagctccacccagtgggaaaacttgaactggtatatatcatgcaccaatcaggattgaagaagagatggggagacttaccctagctgaaatacctccagatgatatga

SEQ ID NO: 139341 - DNA, 1034 bp, Homo sapiens
tttctagatacttatcgttattctaccccaacctctcccagatgtgggagttacaaaaatctcttcttattacatttaaacacattctattttctctgaatttcatattcttaaagaaatatctcctggggttttctgtcttgcttgtctagactcactaggcttgttgcgcagctgtcatctggggatcttggtgaacataatttttggaattctcctcacctgtctattgcataggctctcctcattcctaggtgccatgtctttatttttcttgtttacctcccttgtttggtggaacacatcctccagtagttttcccaagaaagtgtacacagtacataaaagtttttgagagtgtatgtgtctgcaaatatctttattctaccctaagacttcattgctagtttggctgtgtatagaattctaggtaagaaataattatactcagaattttgaaggtattgcttgattgtcttctagcttccagtgttgctattcagaaatctgatgccattttaattgttgttcctttgtaggtgacttagtttctgtcctctgaaagcttatgaaaacttattttcagtgttcaaatgttggcactatttttatccattatgctagtattagggtgataactttgaatttggaacctcctgtacaaatttacttggaggttttctttgatttcctccacccaattgtctccattttctctttttggaatttctgttgtacggatattggatatcctggactggtcctctaattatcttatcttttctattttccattctttgtcttattactctactttctagttcttccattgaggtttccatttctgccattgtgtttttaattttgaagagccctcatccttttactgttttttcaatgtttcttttaatagaattctattttcattttatgaattcagtatcttcattcatctatacaaagatgataatagatttttcttttaaaaatggctttcttctccctgcacatcttctgttgtcttcactttgctt

SEQ ID NO: 139342 - DNA, 1083 bp, Homo sapiens
ttttatatttactgtgcttgtgcacctttacatatatacgtgaattttctcccaaacttaatggacagcccttagaacgagagtccatatcctatatattgttgtatctctcattgggttagcagcgttcttagcaaccagttgtggtttaataaatgtttattgatgaattgtttatttattcaacaaccatttactggtcacctactatgcaccaagcattgtgccagataatgtggataccaagcccaaatctatttagatataaaaacagggaaattattaattgtgtagaagatgagttgcattagatttgaaatatacaaatggtcctgggaaaatccagaagaggggcgtcttgcatagaatgggggtataaacaatggttgtatagaagagataactcatgagataaatgttaaataatgagtaggaggtagcccattcatgagggtcagagaaagaggattccagggaaagagaattgcataagtgcctaaatggattatgctacagtgataaagtcccagtgatgaacctaggactgtaggctctaacttggaagtcagctacaagttcattcactagggaatcaagagactaataacagaatatatttcttggcagcctattagttcatcgttatgcaaaaagtaggtttttatagttcagacagagaagcctccatctaagcctcaagcttggcaagtggaagctctgatattacttagataattatgtgtcctcccaccagatgcaatgggcatgctgttcttggaatataaaaaaggcttttgaccagctgctagtacagtaggccctttaggccacatttcctaggatgcttggttacactcttgtttagcctttcttgatggcaaaagtcatattcacaaattagtaatacatttgaatttgttttttatcacagaaggatgattttcagatgtatgcaaaatattgtcagaataagcccagatcagaaacaatttggaggaagtattcagaatgcgcatttttccaggtacagtaattattcaagtattggatatattctttctggaagatattgcggtatttctt

SEQ ID NO: 139343 - DNA, 1685 bp, Homo sapiens
ctatgcattagctatttttaccttctcatgatgataatacttgaaacattgcaatatagatctcagtaataaaataactgataaatatggtcttttcattttagccacgtactaaatgaactgatacagactgagagagtttatgttcgagaactgtatactgttttgttggtaagcgactcaaattgtatttgccctatcttttcccgaatgatcccttgctacattcattagaaagtgtttaggggcaatcttctacttccgtctccttccttggttgtcatatggcagcagtgggcatttcttttattgtttgatgcagcatgtcggttaaacgtgcacattcaggctctccctcagtaatgggaatgattgattcagaatttattacagaagagaaaatgttctcttagggatacagccgattgttacaattattcccagggtgctatttagagatcgtgatgtaaaaaactgagaatgggataaaatattcttttgacaaaaatgtcatgatattaatttggtctgaaaaaacctaagcacgtattgccaatttaaggagaagctgatgacctgtagtctatgtttttatcttggtttctatcttgtttcctacactacaagctactctgaaggccaaagagctattactttattctgcctatttgattggaaaacttgacttcctttccttgccctgccttctaaaaaaaaaaaaaaaaaagtcatggataactttgggaagtaggagatttgaattgaattaaaattgaaataaaattcaaaaaacttcaccatcaaatcccttaatattctgctgtacctacaccattagtagcccaaccaaatgtgcatgtaattattttaaaatgcatgaatgtatttattttgggtagggttatagagcggagatggataatccagagatgtttgatcttatgccacctctcctgagaaataaaaaggacattctctttggaaacatggcagaaatatatgaattccataacgagtatgtaattgctgaattgaatatttattttttataaaactatttaaagtgctctctttaccagtttattatatttcacataaaatcatgcaattttttttctctgaaattttcacagcattttcttgagcagcctggaaaattgtgctcatgctccagaaagagtgggaccttgtttcctggaaagggttagttaaattattttttaaatatatataaatatgcaccaccaaaatagcaactcacttataagaacagatttggagacaagataggtactttatgtctttatgtttttggagaggacacattactccagcaagtatttaataccaaaccaagttttgctgcagaaatggatgcactgggatatccagagcataaaaataccccttccattctgtggtatcaaatgcttcagtggctcagctcttgaacactgactcctgggtaatcctagtaatccagggaccatcctgactatgaagatgtaagagttgggatcatgataacaaaaccatctggggcttggttaatttttttttttttgcctaaaaaacaccttattatttatattatttgtcttattaaaatacatgtaaagttttagaattggatctagtctgactttcagccatcaaggcatctatcacaggaacttcacagaaac

SEQ ID NO: 139344 - DNA, 1008 bp, Homo sapiens
cttgccccagatcttagaaaaaaaaaaaggaaaaggatcagttatgtcgtgtgtctttgattaaagaattcaaggatgcatataatattttctagaaaggtttccatcaaaaatcactatggttaaaaagatgtttggttcttcaatgaataccctttagttatctagaaaattaactttttatgaatcaaccttattttccaagaatgccaaataaataaagagttaatacataaaataagttctaattagtatcttaaatctgttttcttaggcaacttaaatcactttttactagtacgtatcaaagttattttgaaaaaaatcatagttttatttttcaatttatcttcagagttaggacctagaataaacttaatttgagctggatcgccttgaagaaaaattatacctacagaggtgctaatttaacttttattttctgtatttcagattgaagtggtgcctgattgtcaggagaagagaagttctggtccatcctccagtttggacaatggcaatagcttggatgttttaaagaagtatcctttatttattaatataaactcacatacacatctaactgtgggagtctggttcagtgttcaaggccaatgtgattagaaatttgagttcacagaatggggttttactgggtgtcagaagtccaggatttaggcctggccaacctatagcctatttatgtgatttgaagaaaattaactaaactttttcagaatgttggtatcttcttttttttaccccagactgaaataaaatggaggttttcgtttatcattcttaaaaaaagttttattattatttttcattgacacataatcattgtacatatttatggaatacagtgtgaaattttgatacatgtgtacaatgtataatgatcaaatcatggtagttagcttatctattaattcttcagctttattgatatataattgacaaaattatgtatatttaaagtgtacaatgtgatgctttgatatgtgt

SEQ ID NO: 139345 - DNA, 1397 bp, Homo sapiens
gtgaagtatggagtctagagaacatagcagcccttcgttttcctgagtgtgcctgtcactggctcctgctgaggagggaaggacaaaaggtttgttcctttcctggagagaggagtctcatgcagcctgtgtgagtaacagccttttcagcagccctgagaattaggatctaaacaatctagtctttggttggaccatgccttcggctttgtaggaacgtctggattccttgcttaataatacagtggctcaccctttttaaactaaacatttaaaaaataaagatgaaagttttgaattttgatgacatgtttaacattttatcatgctttggaaatgtttatatggtggttagaaacattctgagagtagattatatgaatttgaataccacctctgcttcttggacaagatattaaccttaattccttatctagaagatagggatagaagttgttacctacctcttaggatgattttgggtattaaaaaagaagatatatgcatagctcttagaacagtgctcaatatgtagaaagtgccaaacaagtgtagatgctctaattagtagattaaacttagattgttttcaaaattctttttgattgagttaatcaatgagctacaatttgattaaatgtttttgtgtcagaatgaatactaaatctgcaaataattatgagcactaacacctacctcaatgcttggcaagtaagtgaatgtttgatgaatgagagaatgggtgaatacatagcaaaatcatgctcagtaagaagctgaaatcatgtgagtaagtccaaccaaacattatcttctatagtgtgattttaaaatactaatataaacatattggaatattaactcaagttatttaataaatatatatgtatttctattaaaagtgctgactttaattctggtttgaaattcttctttcacatttctctaccagggaagaagacttggagacaaaatcagagcaacttaaaagtaaatatcattaattaattcaaaattgactttattgctttagttgcagagttggtatgagccttaaatcacatgtttcattcactagacaaatattgtgtctttgaaagactatttaaaagaaaaaaagctgctgctgcattgtgtttcactgcattactggcatatccccagatatgccagtttctcagtatgagctgtttctcaagtcctggctcaaggttagaatcatttctgtagaacatcttgtatatgttccagcttctttttaccaccacccaccatcacttcaataatcgtaagtaagcgttgcacctttgtgcagaataaactttctttcatgagcaattccagtcctacaagtatgaagcacacaggacaggttctaatggaccatgcagaggcta

SEQ ID NO: 139346 - DNA, 1005 bp, Homo sapiens
gttattgagaatgggagatattgacagcgaggaataaaatgtaaaatgtgacttgagctcctaaatctggatctttagcctagatctttcttctaagctttggatctctgtttataatttgcctttttgaatttcccataggcaactcagactcaacatacctcagattaactcatctctcctgcaatctttctactcttcatcttggtgaatggcactatgatttccccagttgcccaagcctgggaccttggttcctcctcacttatgccctacctctaattgatcaaaaattctatatcctgtggatttgtgcctactaagtatctctctcgaatccattcacttttttttttcatccccactgctatccttactgccactttcctaatccgagctaacatcatcctggccttggcaactgtgacagtctttctgtctcttccacttaccctgcccacttcttcttccctttcctaggtgtcttactttgtggacattacacacactgttctctctctggaacactatttcctttcctctccctttcccacatgttagcttctactcctctatcagatttcctatttctaggccacttccttcaggtaagcttttcctccccagatctcctccttccctgcacccctgtttgcttaggtgttcatgctgtgtgataacaagtacccccaaatttcttcttggctttagtagaattgtctgttttctgtctctcttgctaaactaagctctgtaagggcagaaactgtgtgcagttcatctttgtatccctaaacacagagcttagcatatggtgtaggtgctcaatcattttgtatgtatttatattgttaaaaatgaatacatctaccttgctttgaagaataagatgtgtttctcataagttgtgcacatatttattttgtatctcttaacgtatttgcaaagaattaattggcaaaactaacaattgcctcttaagttacctttaaaaataagtttgga

SEQ ID NO: 139347 - DNA, 1198 bp, Homo sapiens
gggataaaacccgatagctatgagaataaaactgaaataggttgatattcttgagcagaagacagacctcggttagatttctggctccatgtactggctgtgtgtccttgaacagttcacttagcctctttagcctcagtttccttacctggacaataaggacgataatacctattgactccaacaggttattgtaaagatagggtgaaaaaaattgaagactataaaaaaatacttgataaactggactagtcctttcctctggttaaagctgcttgcttaattgtcctctaaaatctcaactctttctagaggttcttaaagtggtacaccttgggttgaggaacggagttttgaggagactgttacagatccatgcaagtcattagtcactcattagcacattttgttttgtattgtttcatttttttctgatattcttatttaatggcgttacaatttccttctgcagtgggagttggatactctttctttcaagcatgtaaacttttttcaaaaggtacccatctttattatattacttttgccaatacatttttctgagtttgtgtacatgtgaaaaaccagtttggcatctaaaaacagcagcagttcattgttgcattctacctgcaagtaactttttcctgtttttcataataaccatccattattctctttgtattatgcttatgttggaaaatgactatataaaatgtagattatggttctaaattcaatgtctttcataaagtgaccccgcaaaaagaataaagaaaaacaattggcgatgctaaaatgaatcaggccttcttttgtttaagatacttcatgatccaactttttgttaggagtagcttggatttgcttcagtttgagactgcctaatgtatgtatgaggatgaaggcagcttaataaataagtgacatggatggataaatgtttttatctattatacatcatgctttgtaaattaaatcaaaacattatgtatgctacaaaccttgttcatttacctaattgctctgttagtaatagggattataacaatccattccaaacaatttcttaagacttttaatcgctaagccaaatatataaaatttggtcaactcaaaacataagtattaatttctcataaaaatgagtcaaactgtttttttgttctttggttttattttagtttttttttttctt

SEQ ID NO: 139348 - DNA, 2777 bp, Homo sapiens
ctttgggaaggaaactttattcttgtctttagccatcattaagcatttgtattacactttatatttttctaagaatttcatatttcagttactgattttgggaaagtaacatgcaactaagtgttagtgctgagaaaatggtcggactcctgctgcagaataaattagttgttgtgaaataaatgcagtgtttcccaacctcggctgtgtatcagcagtatctgtggagctctgtaaaagtataaatgcccaacttatggcccagagctactgaatcagaatttctgggggcagaacccagatatcttttttttttttaacagctctgaaagcatttctgactcacggaagccagaggctgagaaccactcacttattggacaaatatgttttctctttattaattcatattttttttttttcttcttgattttcttaccaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggtagaggcttttttattttcaaataaatatttaaagaaaattataattgcagtactgtgggtaggaggagttttactacctcacagctaactttatgtcaaattgcacttacattgtcctcttaggggtgatagtagtgccactgtcaagcatcaaataattcaaaggcatatgtttgctatataatgaagaataatttcctttttgagctccaaatccattattttaaaactcttttatgtgctaggtgttctcacacatattttgttgtgcatcactggagaaaggcccaaagctcttctataacagaatgttgggtccatgtcaagagcactttaccccagacatctttcctttgtgctgcagtgaccatcagcagatgctctgtggatgatgttgctttcctactcagtttgagaatgaaagcataaagataggatttgggtcttcttggagaaggaggagcaggcagaagttggtgttaacagggtggacagctataggttagttcagtactgcccccttggaaatgacatgaagaattttccacattgtagataagagcatttgtgatgctatttgctgctaaaatgtgtagttgactctaagattggagcagtatctagatccatgcttagcggaatatcctaggggatgccccaggaaatcagaaatgcagtcatggcaatagccaagtgattctctggaagcaaccaagcttaactctagctgcctcaaagcatctaggagaggtacaaaggtgtattatccattggtggctctgaggagcctgctgcaacatagaagactataacaagaatgtcctacagggtaaaatgtaacaaaatattataccgatgttattcatttgattgtttttataacttggtggctttcttatgctaaacaggaaagagcaatatgccttctttcccagccattatctgattcagccaatgaaccaatgaagggcaaatcactctatgcagtgaccaatttcatgactgcttcttggtaattttttccctcaggttgttttggttgagattttggttttatatccatgtgaacataatacattaatctgtcttgttatttttctaaatgtcttgtagttatattttaaactctaaattatttttttgaccatctgagtctgagaaatgtaatggggtttgtaatgacctcatttcataaaatatttcctataattcttatacaactcgcaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaaggtaaaatgtcttactttctctgtctctttttttcttgctattgtttatattgttactcttgatgtaaatactgagtttattcttcaatgcggatagatgaaaatttcactttagcatctttggtcatatttatattgtgcaaggcaagagtcagattgaggttattgtacagtactaaaacatagtagtgatatagtacagtacaaggaattgtgaacgtctcagtactgagtactccagccttgaaaatgagtatgaaaattttaccagcatcaaacttgcatttttttccagcaggtgaaggaaagtatatgaagctagtatacacatgtgtgcatgcacacacacacacacacacacacacacacacacatatttactgctactctagataagcaatgatttggttcctttttatttgtataaatgtgggagtacaagtacatagagttttgttacatgaatatattgcatagtggtgaaatatgacttggttcttataagcttctagtaagtgaatggcttagataataaaatggattgccttttctaaataaatgctgttaaatagaataattttgttggtaatttactattacagagttcattttctagttttaatctcctagttttatccatgtaagatctattttctttctaagttctatggaaataataattgtccttataatgtgttgaactactctggatatggatggctcaggggttcccttgagctgcc

SEQ ID NO: 139349 - DNA, 1062 bp, Homo sapiens
gtggttccatatgaattttagaatagtttttctaattctgtgaaaaaggctgttggtagtttgataggaataacattgaattggcagattattttggacagtatggccatttgaatgatagtgattcttcaaatctatgagcatggaatgttttctccatttgtttgtgtcatgtatgatctatttcagcagtgttttgtaggtctccttatagagatttttctcctccttgggctacatgtattactgggtattttattctttttgtggtcattgtaaatgaaattgcattcttgatttggctttcagcttgaacattattggtgtatagaaatgctactgatttttgtacattgattttgtatcgtaaaactttcctgaagttgtttatcaattctaggagccttttggtagtctttagtgttttctaggtatagaatcatgttgtcagcaaagaaagatgatttgacttcttttctgattcctagttttttgattgtttataatttattagtgttcttgactattgtggtgtttcaaactgctgctgtgtccttgtgacatactccaacatttaaataaatcactttcttactttctggcataaaaatatattccaagttcatcttgtacctattctgcctcaaccctggaatcagttatttccttgaggagccctggtttctttttctgggaaatggtattaaagaccaaggtctgggtgggagatgtgcttattacttctggagggcttttgcttttaggataattcaccagagagctggggaatgatgaaaaaaacacttagatgaaaattctcaggtaagattttgttttagatatttgctatatatatatacacacacacacacacacacacacacacacaaatgtatatatacctatacatacctcacacgtatacatttatgcaaatacatgtcctcatatacgaacctacacatgtacatggtgatcttttatacatcaagagtacacattgatatctatgaggttaaattttaacagattatagctatttctgtgaataaaataaccaaa

SEQ ID NO: 139350 - DNA, 1053 bp, Homo sapiens
tgagatagcaaaagtaaaatgttttacacagtgcctagcatatggcaaaccgtcaataagtgcaaatagtattattaatctcattattctagtgatgcttctgaggcatttaaatttgtagcaaagactgtacttctgttttagaaatttacaaataggcaagggccctgcacctcccaagtatgtctgtggtatatgagtatcttgacttctaatcccagagataggggaacccttctgaagaaattaatgatgtcccattaaattaggattccattttcctcatacttgttcttcactcaacatttcattcattaattcatttaacaatgcattcattcaacaattcattcattcacatgaagatgtattgccaaaattagcaatgcctagcctttaataacctgtaatgctataaataaacaagcaaatattttgatatgcatggttaacagatggtcatatggtctctacattttgcccttctttctcagagtaattgattttagaaacaaaagaaacaacaaaaccgtacttaccattttatggcaacaaaggctttggggccaccattccaaatattctatagtacctgaaatgagttgttgtgactagtttttcccccgtttccttcaattatcaccttgtttggaatgctaatgcttattcacaaatgataataaacaaatataaagtgactttactgttctcatctctcttcagaagtaaggttattataaggcaattttgccaattggagagtttatagaataaggaaaatactgtaattttcaagaaaataaaacaaactactcaatacatggcatctttaagaaatagttttcattagtgtccaagaaataagtcaagaaatttggataaaagatattcaggaagactcttaatcttccttcagtttcttagagttttagatgaagagttacagttgattgccaagagcaatgccatatttctctagcagaggagagttcatagtatatgtgtttgccgttatacccccaataaaaacaaatacacttactgatccagttt

SEQ ID NO: 139351 - DNA, 2185 bp, Homo sapiens
tgggatatgttactccgttctccacttattttgcaatgtgtcctccttctttgtcttttgaattctttagtgtagcagttatttttgactgcatactatgtgccagcaagttctagacgctggggaaacattggtgaactagaacaacattctgatccagttaactcctcgttatgcttcaagatctttttgaccttcctatgtctcggagagtttgtgctatcatttccccttgtatattattctaattcctttgattacttatcaatttagttaaagaattgctgattagtaatggactctgcagttgaactgttgggtagagattgtgttttcttaatttgtgaacattcaatgcctaacagagcttgatattcatttaaatacatgaagtagacacatagaagatgttcagtaaatattgattggattaaaataaaaatataatcccataataaagttttctttcattgtttagtgtaaatacacagacaaaaaccctttgacttttagggttatcctaggaaactgccacctaattctatttgtttttataggaaataagtgcaatttgagttcaaataactctaaaataagatttagagtctatttcttcataaggttggatctacttctttagtgtgagaaaatttcgtaccagaagtgttgcaaggatctgacctggagccttacattatttttctatttgcatgtttttagattttatcaatatccatttgtaaagtgttggccttttactggcttttatgaatttaaaatttgtttccttcagttacatattttctgatatgtgctcagttgagtgtgtgttgacaattttttttccaatttcttttgttctttctttctacaggcttccttccctgggaacttgcacttggttttggttttacgtcctaccagctttcttcaacgaacgttcacagacattggattttggtttagtcaggaggattttatgcttaaattaccagtaagagtatattatttaaatgttttgttcctctaattctcatgaagacctgtaccatgctgtttatattttacatgtgcccatgtgtcatttaaaagaaaaaaattaaaatgtcttttaaaagtatacatttgaaatgcccaaaagtctttcacttctaccatttgaaaaagaaatcgattcatcaatttataacaaagcaattacttttgcaaaaaatatatgtcatatatgttatatatatgtgtatatatgtatgtgtgcatgtgtgtatatgtatgtgcgtgtatgtgtatataagcaggaaattttatttttagtaaaattgagtgtatgttttatgtatttgaactcccgtgaacttacatcctgagctagtccagagtaccatgactttttaaaaatatttttgtttgtttttaaggttaggaatagggtgctcataaattttgatacttttgaaaaggtcagcccctcctgataaattataacttactacataaagtccttttctttgttgtgagcatagcattcttttagaagctggaccattaacaatgcaaacttttagatggaggaaaattaggcgttttggtttctgtggagattgatttagctttacagaaaatgttttgtaaatagaaactgttattatctgaagaaggtagcgcatacatgtatgggggcatgtacaggagagaactgttaaaaccatttatcagaggtaactttctgctaaatgtatgccaaagttcattttacagtttaatggagggatggcatgaagggcagttaacagtatcttttttgcttatttatataggttgttatgctgagctcagttagtgatttgctgacatacattgatgacaagcaattaacccctgagttaggcggcaccttgcagtactgccacagtgaatggatcatcttcagaaatgtatgttgtctttgcccttactgtagagcctatagttcttcatgttagcctttaaatctagttctagaattctttcctatttgaaaaaaacaaaacaaaacaaaacaaaaaaaccccagctttctgggccctcatttttcacatacatataaattcaacatcttggttttcttccataggcaatatctagaaatgatgagcagtcactgaggatggcaattgaaggagaatcctagggaataaggagatca

SEQ ID NO: 139352 - DNA, 1048 bp, Homo sapiens
cttttatgttttataagttactttaaacattctagaaataataactagaataactgaaaagtgtgcatagggtgatgaattgcctcccttagagagcacacacaagagtattaaacaaggttaatttctagacttcggtagtgaaatgatgtatttggtttacgcctgctcttgttgttattgttgttgttactgctgtaagatcatagaactaggcaatctggaagtacgtgtgagtaaaagggagtaaatctgttctctgggagggaaagatgagagggagcttattttgtgctcgttaccttgaagagcctgtaagagctgctgctgagggctggggtgggaccacgtacagtgattggacacatggctccgagtcctatgtgataggcagctggttcgcttttactgagatgtctttaagcagtcacatgctggaactccagaaaaatgtctgcgagaacctaaaaccaatgctgtttcctctctcgtgcaaactatttttttaaaaaagcaaaaacacattgaaataaaacaagactaacctttgcccaaatccctttgcttttttgacaagttctcaaaaatgaattatactttcaaaatctcagtttttattttggggaaaaagaaattgtgctttttcatgtttatataaccatacagattagaggttcttaaagcagcatacccaagaatttagaaatataatattcccaaaccaaaatgggaaagttcactggtcttgaactatatttgctttgatatgtgcatctgataccctatgctgtttgattgttcatttaaatactagctttaaaatggattatcttgagaattttagttgttacaaatattggtatatagagaaaaagtactctctatatatacttatatgtatatcaacatagatacatacaaactaatcttaaatgtatatggcttgtcaggttaaaattgctcaagagtgttctgtcccctctagattctcatagccggcaatcacagataaggacgtgtccatattattgatattgattgatgttca

SEQ ID NO: 139353 - DNA, 1036 bp, Homo sapiens
tgcttgtggtatagtttctatactcatactcaagagcacattaattacatctcaaccattagtaactgttggttactgtttgaaataaaggtaaatattgaatgcaagctaatttcaagtgcaaaagttggcattcagaaaggatttctagtgaaatctaccattgtgtagctaggtataattgcctgtggtgtattatttcaaacaagtgtctgtgaaataatcatacaattcaatttgaatacctttatttgtagatttcaaaacaaataaaagcatttaggttgtatttcataattaatgagaggagactttattttagttatacattttggggaaaggttaatttgggagagaattgtatccgtcttagaaagtttgcatgttctattctttctagattattaccaggacaaaattttgcaaactatagcctttcacaaggcttaaacccagaatacaataacagagaaaacaaaacagaattgaaatttaagtcacataccagggtaggacgagagtaaaaagcatgagttaatactaccttcacaaagattcttagcattccaccttaaaaatcaaactgcgcagaggagaaagccagtcccatcaagcctgctcctaggaagagagctggtttttttttcctcctccttccactcttaggacatgcctgatcttcttgagcagtccagcacaagctaatccacaaggttcaatcaggctaagtaattggaggaatgtgttaactctgaattacaaggagcagaagggaaggatctgtcagctgactaatcagggatagtggtttttttttttttttcctccccagcattgctgccactgtgctaatggaagcagccacggcagctttgtttgatagagatttttggctgccgtttttaaatactacccaagaagcagctcgtatttcatcaacgttgcgttgacaattggaaaagaaaagtgtaattgcgtacaggcgaaatggcagaagcaaatccccggagaggcaagatgaggttcagaaggaatg

SEQ ID NO: 139354 - DNA, 1078 bp, Homo sapiens
tacctattgaagcttgaaagtgatatttttagggcaaatagaagttatattttccattaaactgcatttcctcaggagcagactagagttagaaaaatagatttagcagtgtgattttgaatgagtgaatggatcattgactcatgatggattgcatggaaagttaaatctgatatcatgaaggacacttatcttttgagttttcccacacccaagattacagtattctaaatcaattttagtgacctatcttcattacactatcactttcctatttaaaagattgacattaatgctgcaaaagaaattttaaatagtgagtaagggaatatgtattcagattagttttctaagataggactttgtgatagctttccaattccaaatctgtcttcagtcaagacatcaaatgtagatgaaataatcagaaatagaatgaaggcatatataacaaatttgcattattattaagaaaaagttcttatttcttcttatcgttcaggcaaaatggatcagactcccggtttaccattattctggatcgaagattggatacatggtcttctctcaaaatctctctccaaaaaatctcggtaagtatctatgcattatacagtaactttttatttttgttttatattatactttctgttttgggaggtatagattactttggtactgacggagacaataaaaattgatggaatgtgaggagggaaagtagaaggagaggttgtagcagagactgagataaataactctacccaaaataaaacctagtaagaatgagtgagtagtttgtggctccagttatgagtgagaagagattcatggttctatgtgcctttcaggacaaggcaagtttttatggaagctttttaaaattatttatttatttatttattttggtggaaatagctgtgttgcatactcgtatgtgaaaaagtataaagaagaaagtttaaaacaatagtaatccaaccaccccaaaataagcagtttttaacatttcagtgtacaactttctagatttgttttaccctaggatagggtagggagatgagtcacatataaaatg

SEQ ID NO: 139355 - DNA, 1050 bp, Homo sapiens
gaccatcacctatttcctatagggtgctctgtatcttttcctgctcaccatgacactaagagatcgattatatcaaattttccacttgctgtcaagccatcattcactcattttaaatttaggctcattggtatagaaacagttatttcccaaccccttggttgtccagattggggaatcagctattttccactgtatttattatatgcatttcatgacattttcttctgactatattcattcattttactctctttctttttctttttttattgagaaactactctgccaccttttaaacttaaagtgtcaggaacttggagccattttggttttatgtggagatcatcatctttgcaaaaaagttgtgttgctgcaaaacagtattcaaatctaaaatcctcttcttgcttcgttgttatatacatttttaattcagttgattatttttctattgttgtaggtggccggggaaaggacaatgcttggatcattacgtttccagaaaactgtaattttagatgtataccagaggaagtaatagcaaaagtacttacttacctgacatctattgcaaggtatagtatttcattacatttttttcaattcgctttatatcagatatccatctgaatgtcataacatgaaaatggcttaatatagctattattatcatggtgaataaccaactgacttaacttcagagtagataagaagtacaacttagaaggagaagctggcagctacctaaattgttacaaaaattatcctgagaatctatgaaaataaaattggggatctaggagtatttgttcccatcaaaaagaacataggttgagaacgatggtcatacatatatgctttaatttgcttaaaaggaaatattaccagccaagagtgagtacagccatttttcatttcttctgaatataacacaagaagactgaatcttaagtagattcaatagtggtactgggagatactaggaggaatgtcttgaaattaaaaattatttggaactagaatgctttaaaatggaaagtttaaaaa

SEQ ID NO: 139356 - DNA, 1036 bp, Homo sapiens
tatttacactcccatgtttattgcagcactatttacaatagccaaaatatggactcaatctaagtgccattcaacagatgaatggataaagaaaatatggtatatatacaccatggaatgttattcatacataaaacagaatgaaatcctcttatttgcagccaaatgaatggaaatggtggcaattatgttaaatgaagtaagccaaacacagaaacacaaatactgcttgttctcactaatatgtgagagctaaaaaaatggatctcatgaagatagagagtagattggtggttaccagaggctgggaagggtagaggggaggggatgaaggggaaaaaagaatgtaaatatatttattaccactgaactgtacacttaaaatggtaaattttgtatgcatattttaccttgataagaaatataaaataaaatggaggtaatgaggtgaggagtggggagtgacttgttgaaaattacagagcagctaagtggtcaagcccacactaggccctggtgctcccactcccagcccacagacttttattttgggtcctgaggcctctctcattacatgagtgcttaaattgtagagtaagtggacatagtttccatagctatgcaagagtctgagtggtatcagagaatcaagttgttcatattaatacttccagatctgccacctgacataaaatgcatcaattcgtctttgtacttgttcctactgatcaaagcaagggagaaatttgggtctcctattatgtaggaatatttttatgtctgatgctttctcatttaaaaagtagaacacattttaactattgccacttttgcaggctcctcaggggagaaagtgttcttgtatcttttgcattaccctcattctcacccttcttccatggctccatgcctgaaaatgtcaatatgtgacacatgtttgtagctgttataaacacattcttttatctgattaaacatctagcatggaaagaataactgcgagtgtaaatgtgcatgccttgatctgaaatatatc

SEQ ID NO: 139357 - DNA, 1059 bp, Homo sapiens
gtgtttttaagggtgtttatcagattacctgttgagttacagccctttatttggcttctaagtcagctcctttttgggcttagcaacgagtccaatgtaaggagaatgaatcctttttatctgtgagtagttgagttttctacatgagacagcttgacaaccttcctatcaaacgtaaatctagtcaacaaggaacatgctgtaatgtggacttgatccaggtttggtgatctaggctttttatttctcatgctctaagtgaatgcatttaaaaggtcagcaataggaacagtataaattatttgttctcacttttatatttcaggaaaaaatccgtgtggaaattcgagagggtcagctacaaagctgggtgtaactcagtgtcacaactttatctaaagtcagtattttctgtttctctttgttctcagcaacaatcttacctcgtcccttgcagctgctcaattgataactgtgtgtcttctgttgtctttcctgtgttatcttcttccccttcagtctgtttccaacccagaacttgatcatttattaaagtagtaatattttctcttgtaaccgtgatttcatcctttctctttagtgtggaaatgttattttattggcacagttgtgggctacattttatgatagaaaacatcagtctgtttttacatctatggattttacatgttgttggatctcatagaatgtagggtaccttaaaaagcatttactggccgggtgcggtggctcacgcctgtaatcccagcactttgggaggccgaggcgggcggatcacgaggtcaggagatcgagaccatcctggctaacacggtgaaaccccgtctctactaaaaaacacaaaaaattagccaggtatggtggcaggcacctgtagtcccagctactcgggaggctgaggcaggagaatggtgtcaacccgggaggcagagcttgcagtgagccgagatcgcgccactgcacttcagcctgggtgacagagcgagactccgtctcaaaacaaaaacaaaaacaaaacaaacaaacaaaaaaaaacag

SEQ ID NO: 139358 - DNA, 1143 bp, Homo sapiens
tactcatcagagtatagctcagggagatatgtaaatcacaacaaaatttattcagtgtgcattccagtatggtatgaagatttatttcaatgatgatgggtcatctattaggccacacgatactgtgagtgttccacgtaactgatttttctgggtaactgaggttcaacacttttagtgcctgactttttccccttaaaatatgtatccattttggatgagaagcttttcaaaaatactatttaccttcctgacccctgaacctggaaataattgcatccttttttgatgggttaagattgtccttataatagcattagttctttcaatgtgctgtattcagtgctgcctctgggctcctaaactgtggagggctgtttgtccctatactaaatggggacagattgttctgctttttaattttcaatgcctgacttttaccctctaacttttccgtagatttcctctctgttagctgatattttttgctgctgttaatttaactgtttctactggccagttgttattgcctaatcctccatgccccctcctccattgccttctctgagtgttacgaactagggaacaagataatcaagcttgttcgaactgtgtgaaaagtataatagaccatgagtaggcctgtggggaatctacctcaactaatgtatatgagctttagtacatggactctgtgatatctattccaattgcaaaacatctttttcttttctttctttctagttcctttgtgtgttttggagggttgatgcagttaaataagttatcagtaaaaatctatgttctcctgctaatcgaggcataataacatgtgaaattgtaatattttacttccttgtaaaacaaacaagtgtgttcagaatctatcagcaattccacgtgcattttatccactgcatttctcagacatgcctgtgcttggcaccagaaggcacttcattcttaaaatttgcccccaggtttgaaagcaattgtccctgtctctgctcagcatcttcttaagcaagcatcctctgaaggctcaataaacaacttgcaccttacctactctagggcaggagcagaggccaatcccatgaggagagatgccttctatctgatggctgacaaggccagtgcctc

SEQ ID NO: 139359 - DNA, 1236 bp, Homo sapiens
gtgaaatgtcttcattcaatgttaaacacatacttttttggatataaatgaccatatttatttgactgctagtttttttgttttttttttgtctttctggcatgcctgtactattattaatgtttatattgtaccttgatttggaaaagtattggagttaatctgtattatatttatatagtccatatggcacatttgattcttccacatatattttgtgttaatgtttaggtatgatttttttctaaattctagaaaagaacataatttcagttatcagaagccattccatcattatagaccctttttcattatttcatttgctctcatatatcagtattatttttgagcattttgttacatgtcattcacaacttacctaagtgtgctgtgttctggtagcccgtatttgaggtaagctgctgaaaacaaaagtctctatattctttgcctattccaaagagctaaaaaagtctaacccaggaaagcttttgatattttgtgtttgttttcttgttcttatggttgttgttgctgtattatgattgctgttttacataaaatctatgggaactgtgaatacagacaagagagccacagtagagaggcttgtttaatgcagtaccattggagagttaacagaataatctagtagaaaaataactggttgcatgtaaaattccttccagccagaaagaaagaaagacaaggagtaagggggatttagagttatgtctcagctacacattacattgtgatactgcagctcaaattcagaatggcaatgatacatgatatcatggcctagatccttgagagggacctggctttcctttttaaaagatattttactgaagagctaaaaactggccagtgtggggttagcagatcgaataacttgaaatagaccatgcagtattcctagcactcaatgtaatcaccctatttgtgacagagaaagggaaaaaaatataataagatcatctacctataatttgaataattttgagctatcaaaatgtctttgtaattttcacaaccgctgtccattgtttgaggatgttacctactaaactgaaaacattcattccatatctacttacacatacaccagcaacagtataaatgtaagcctaactttgcaaaattcgtaataatttagtgatggaattttttaataacatgcagtatataaatgtgcagattttatgcgtgttgacaaaatcatttttcagc

SEQ ID NO: 139360 - DNA, 1266 bp, Homo sapiens
aagcctgaatctattcagctgacaaatgaagaaaggattaaaatctggttatagtgtcactctttttttcccctgcatgtgaataaaacttggcactttgttaagacagttgctttactctcataacaaaatttactacttatttctgaaaatgcttaacagatggtttcacattattaaaataagccttttaaatctgtatattttacatttttcagaatccgaatcttgaactgcctatgttattgtcctacaagcatactgacagtggttacagctaaaaaagaaagcatgaagaaacaactacaaaaagttatcatctcaggatacttgatacgcaacacactaaaccactctcatgtctagagttcacaataaatgttcattaaaataccaaatgattctcttaagcatttaccattattgtaagtagcctttatggccaaagctgtaagttaagaattatatgaaagttgaaagcaagaatacttagaattctggctttagttagagtaatataactcaaatgggtgctcttttaacccatgaactttgtgaatggatttaaatacaatagtatgaagtagaagttatgcaatgagaatgaatagattttgctaatactactttttttgcctggcagaagaaatagactatttggatcacatttctcattcctcctaaatgatcatcttaattttttttcccaagtacataaggaatacttgaaaatacagaataactaaatagtatcaatgcatcagacagaatagttaatcccttctgtttacccatgtgctactaatgtcttggtagaatattcttgccaaaaaaataccttgaacgcttatgtggaaagtgttaacttacgggtatttttgtgggaatagaaaaaaattgtttattttttattcttctgaattaaaccccacttatgggtgtaagcctactagacttgaaaataaagtataaaacatttccaatcacttagtagcccctcaaagtagttagaaaataaacagatttttccagtgttgattttactgggatctgcagtaaggtggtttaaaccatagttatataaaaataaaggtcattctgaatatcagccttttataattttatgtgaagaggaagaaatatagcttattttaaacttttgacggtttttatttgaaagagattgcatttatgcatatatgcagtgctttttcttaaacttggccaatttggaaagggggaaggagccaccccaaaacggtggtt

SEQ ID NO: 139361 - DNA, 3379 bp, Homo sapiens
caatatgggtaatctttattagcagagttgttcaagtcatccacattgttgaccactcatcttctgttttgcttgggcaatgccaaaactgagtctgtaaattaccttataatttcaggcacagaatcagaaggaaaaaaataaccttaggtttgccagttaaactttatccattttcacttttctgggtgttttaaggggaaaaaaaataataccttacccaggtaaaatttagcctatctttctaaagaggactctgtaggaaaaacagggaaaccaatcaaattaggttgtaagaaaggaagttaagcattggtcagaggcaaatgggactgaaatgtggtatcaccaaatgttttcccattgttatttttgattaagtttttatcctgcaactgcttaagagcagtcagtcccttcatagtgtatctgtacagttgcataggggagataattacttcaagatagattggtgattggcaatggaccctggacataactctttgaccaatggattttgaacaaatgtaggatagtgaattaatgattagagataagtcttattttaacgagaagcatattttaaagctattttatttaaaatagtcaattttcccattaacaaaataatttcaaattgatatgtagagaaatagtagttggcacgtaataatagactattcctatctctgactctgcttttacttcagaaaataatgtcttcaaaactaacatatcatttcggcttcgaattctcaagttttctttttaaatgtcttacatttgagagattatttactttttttttttttttggtttctgcatttctcttttttctactgcaattttccaccttttgtgcaattgtgaacaaggtaacgaaacgcctcccttcctcaggaacatctgctatcttcatgctttctcaaacttccagcaatcacagtttctcttggagtgaataaggtgatttcctttcttaatgtaccaacttgcttgcattctcatttgcctgacaccattttctaattctttatgaaaaattacttctcatgactcattttatatcttctattgatgcttagagtattttgtcattttcttttaatcatgtgttcaccttccaaattgtcacactggagaggaagtaatttttaaaagcttggactacgggtctgtagtcttcattgatccacggtatgcagtggccatggcgtgttagagctagtctgttcaccaggacaggaatgttttgcacaaatttctctttgtttgataatacggcaccggcacaactctcagaggtgttcaccaaaaggatggtaaggtttactaatcaaaccatattgactcatcttaccatattacttaccagtgccattccaaaaacccaagtttactacatactactgttgtctgtttacttctaccacaaaaacaattcgagttggagactttcttaggcctttgaatgtattcatttgaatgttatacatttactatatagtgtaatcatttgtacttttggccagaggagtagtctataggaaatgatttttttcttttacctttttttaaatatataatcaccaggtaggttaaccaattttcaaatgctttaagtatctttgcctcactattacagagaaatctgagctgtagaagggcatctgactcattatccgccagaccttcagtcagacctcttcttttacgaacattctcagacgaatctaatgtattgtaacaggtacctagtgttaaacaaatgggctggctttaaaaaatcggattaacagcattataaagaaaaaatgaaaatatcactctctaaattttctctgctgttggtgtggtgaactttacaatattctttgcaaaaatataaagatgcattacttggaatatggggaaatatgcatttaaaatattaaacattaaaatatgataagccccccaaataaaatgttaaacatttttcagagccaaatgttgatacagcatatttaatttgtaaggggcaagttgtcatggcaaggccaccatgtgaaaatgtttgttaatattgatcaggaaatataactttgatttataaagatcatttggaaaactaaaagtaaatattccaaaattgcatctgtataatatcaagccaatttagcattgcatgttctcttgggaattatgtgaaaataactaaatgtgtttgtaccttcatgtgctgtgtctgtgtgtttgcaggtactgtatacacttatgtccttgtaaatgtctgatctccaaatatatatcaatgaaccagtctaatcataacttttttaatgtcaagttttattcaagctaaatgtttcaactttcagaggtaaaatatttcatagccattcagggggatgcttgcctaatgatataaaatgctttataattaatgtttccaaaaatgattaaattcactttataatgtttcatttacccccaaaaatatttgggaggaattgatacgccgtgggagggccccttgaactcagaatgactcctttatgtatagtctgtatttccttcagtgggggcctttaacaactcagacctctggaggtcttttatccatccataggaatttagagtaattaatgaacaaggcttccaagcttgtcagcttggaaacaactctacacagcttaaagcagggccatctttcatgcacacataaaaattaatgatcatcatgaatacaattgtgggttagttcactttgaagctaataattgcgagtccaccttataggcccatttttttcaacagctgtcaactctgccaccctctagcaaagaatacaagttaaattaatggattgactccattggttcttctgtcttcctggagttcatcgcagtctacatctgcactgttattttagaagcagactcattttgccacagttagcatctttttacccatttttgaacaacttacctgagtatgttttcccttagtaatgaatctgcttcacaagtaaccttcaaggtctttgacccctttgtcccagattgcctcgttctaagctgtgtgatgcattttagctatattgtttctggctaattttgtatccccctggattgctctctttagcttggtctgtggtttgggggactgggctggatagaagacactgctgttgcttttggcctctccagggccttatctcctacaatgtctaacatagaactgaggaagtattttttaaaaacaattgtcttatttttaatgtagttatttcttccaggaatagattttcatgtggcattatttctcctccaaagacaataattagcagctagtttaggcatctagtttgttccttggttggtaaggaaactaccta

SEQ ID NO: 139362 - DNA, 1087 bp, Homo sapiens
tgtaaatcaatgaaatatatctggagtttctggccaagtagcaaataccatttcacatttccaatggagaaatttccacatatcctgtgtgaagttttctcatgtaagtcaccacaatcaaaaaggaggcttaacttcgctgaagcttgacaaaggaagactataatttaatgggaatgcacccagcaacatggccgtgcttagcatgggatgtcagcacaaacaggaagaaatattccattatgtagagaactctttcagagtggtagacagggaagggaagaatgtcaactgtctgagccaaagtcccagagaaagcattttggaaattttggagaatatagttaatcattataataatgatgattactattatgattcttacagtgtcatatacaaccatgggttcacagggcaatagccctgttagctggattagacaaaaataaagtttaatcctaatgtcgtggctgttgagatgggcctttatccattggcctctttgacatactgctaattgagctggtgtcaaagctctctagatgactgcaaaggaatgtggaaatttcattctgttttagctcattatctcctgtttaccccaccccactgccggttgctagctatatcaatttttttattgctttagttactctttccatgctttctcctgctttctgtactttcatttcctttataaagtagttttaacacctaatctattaactcctaatatttctgcttcatagaaatacttttatctccgatggttggatacaagtgtttgagcacaccaaaacgtgcttacagttgcagtcttgaatagataggtttgtgcattaaacacgggggtggggaacttggtatcatgctgatcttgtcgcagggtttttgcccataaaatagaagatagaaacaattaaaatctttttctcagaatctaaatattctctagctttatcaattggtaatttgcattctatcaatatgtctatcaactttcttcattccaccaactttcttcatttaaggtaaaaacaagaaaaaatgtagttgtcaaaacatgaataaattatttacctttgaa

SEQ ID NO: 139363 - DNA, 1035 bp, Homo sapiens
gtctgttgtgtttgagctttcacgacacctttgaaagttttgtagtttgtctacccttcctagctaccccttccctctcctacttcttttcagcttatctgcccccaccagctaggtctccttttgccatcatcttcctggctgccattgcctgaggacttggggcttgggcctcctagatattaccattacttcattccttgcccattccccagtactgagatatctgcagccctacacctactagctacttagcctgatcacacctccagcctgtacgccagtttagaggccttagggcagagctcagctttctcacccttgttctttgaaaaacctgggttctgtttagttcccctcttctctggatccctggcccaagctagatcctttcataggtatcattgtgtactagttatcagatactatagcgtattgcctggtgcaattcgtaaccgtcgtgaaatcttttgtgttgtatcttttcagcttgccttggatacccgattctggacgtggataaatcactttgtgatttggggttctttagccttctatgtatttttctcattcttctggggaggaattatttggtaagcaattgtacatgtgtgagcaatatgtaaatagcaaagtagatacatgtgtatgtacactatatatgtaagcattcattatactttaaaaattttaattatataagatgacacgtctttaatattaatggcctgaaggttatttgttagctggtagtgctactaatttcaggtaagattttaaatacacatatatagactgcacaagtcactcagaagacctccctttggtagcttctgtctgtttgaaggtgttgtaaacatctctctagtgaaactatagttttcagcacaacctctcgtgattttcagaggaaatactcatcctgtgaagtttctacctgatatattgaccaacagatacattattgtccatttggacccttattttctcttgatagtatataaccatgattcatgttactacaggtgtgctcag

SEQ ID NO: 139364 - DNA, 1050 bp, Homo sapiens
aaagatggcagccaggcattagtagtttttaatgatcctcaggggattccaaagtgcatcaaagtttgggtaccattgtgttacacctttctgaggctccttattattagcaaatgtgagtggtagtaatacctatctcatgtttttatgtggataaaaataatgtctgtaaaactgtgaacccagttcctggtatataagtaccattaaatggaagcgaattattattgatgttattgttgtcagtgaccaaaaatttggaagagtttagagagtttactccagtggctgagtcaggagatgattgcatgaaggtcagcctttggctcagtctgaccctttaccaaaaatctgtcaggccattaagggtagcccccttcattataacagggtcaaattccacgcccacctttgacatttcactgtatgtttaaatgaaaagtttcactaatggttttttccccccatttctcaataggaaaatttctggcaatgccatgctacagttgggccccttcttatattggacatttctggctgcctttgaagggacagtgttcttctttgggacttactttctttttcagactgcatccctagaagaaaatggaaaggtaaaaagaacctgtcattacatcttttggtattataagcatggcttgtctttttcccataggtgctggatttgtcatatacatactctagctgtaatcattttacaaactttttctgaagatacagtagttagttctcacagcttctttagaacaatagaagtgaaataagaaatcactttctgtgcatggctaactagagagcttatgtgcaaactttctggaaccttaacttggctgtaatttttactagatgaacagagttcttgggacttcagactcctgctctttgatgtgagaaaggtttttcccattttaaagtaaagcctggccgcattcagtttttactcatagtggccttccatgcttggagctgaagcgggtagctgccatatctttggagtgttggcccaatatgtgaagagaggaattctct

SEQ ID NO: 139365 - DNA, 1032 bp, Homo sapiens
tagtaggagatcccttgaagatttgtcatacagatctgcctagtaatctgaacctatttcagaggcttattttgcctcttttgagttttggcctgcaatttaagcaactgccaccagatggaaggaatgctctgttaaggagagcaaaacaagcgttaaaatggcaaatgttgaccagtggttatttatgtagatgatatcctctgtcttcgttagtatctctaggcccattatcatcttggttactgactcagcagtatttcttttttattactatcttttgtgcgaagaggatttctaaaattttcaactctatttggctgagctgagaagtctttccatcctctcgccattgcatcttcaaattgttattgcccactcccggagtacttcagtgacaggtcttcctgccttctgtttctccatttaatcctccttacataattcaactagattagtgtttaaagaatgccacttttcaacttgtcccttagaacctttactctccaccgtctcagctttagtctggcttttaatgcaccccacagtgtgaccctgtcttaccatataagtttaaaatatatacattcttgccttggttcctgccatcaacatgtcctattcatctttattcatagttcgagttctaagttgtttattcaatcggtgaacaaatatattttaaatgtgttaccatgtgccaaggcctgttttaggtgcttgaggatacaccatggaataagacaggcagtgtcccttttctcatgagacttacattctggtgggtgaggtagatacctgctctcccttctcaatggagcatccccatgatccccactgagctctacctgcttcaacctcagaacacttatttttttcataaactgtgactctaggaatactatggactatattttgcattgtaccagaactgataatgtataaatgagtgttgcttttccaggtgatgaccttgggagctctgactcatgctgcaggggcaattcaaaacctgttgagctcatttcttta

SEQ ID NO: 139366 - DNA, 1043 bp, Homo sapiens
ggtacaaggaaacttagagtctccattacctactttttcatttccatatatgctataggatattctttcatatgtgttagttttgcttcatcagattctttaaccacttcctctaaacaaggggatggctgtgtctgtggcttttcttttatatactgtgcgcgcgcacacacacacgcacacatatgcacacacacacacacagcgcccatcatatttgaggcatttcttctgtctgccttctagctctcagtccccactgcaatcagaggctcttctttcttttcttcaatcttgtaaaactttcttggccccaggttgggaatcagatccaaccagaatacactattcaaaagtatctgtccccttagtcagaggttttcctgcaaaagcgatctctttttttccttacattcagtgtatgctgctcaaattgctcacctgggttctgactgcttcactgccaggcaggtatatgaattcctgaccccatgctgcttcttccaccttaattatgccaccacttgtggtttagtcctcattctgttttatttctgtcactatagttattttttgcaggatattacatacttagctgtcatgttcatgtatgtgatattcaagtcactatctccaatccaaatatttggtgatctactttactttttcagctgtttcccaaacacatattcttgggtgtggcattatcaccccaaatctgacttctctagagtccaaccatcattttccttggcatcttctttttctatgactgacctcagtgtacttccagatttctagattcaaaaccttgaaacctgtgttgccttcccacataccacatacattaccctttcattgtagtcttagtcactaaattttgtctgtttcttattacatcgtcttttccatctattcctttcttttcattacctttcagggctaggcctttcaatagctcattgaactcctggaactagccacctaacttctctctttgcccacagtcttgctttcctccggttcttcctacaccctgctgt

SEQ ID NO: 139367 - DNA, 1051 bp, Homo sapiens
aatgaaacatgctaaagtgacattgagtacaaatgtttctgaacattttagcttagaatgatgatactcaattctgccattggataccagttacccaaggtgtcacaaacttttcagaacctcattgtttgaaatttgctttaataagtaaaattatgcccgagacaacactcagaatgagtaggggatgtatatgaaagtcaaccgtgataaggtgtcaggactctagaattgctgtgaattataaaaatattctctttaataagccttcctgtagaatctttgtcaggagttttagaagatcacaaggtttcttttgtgttcccaggctacaagatcaagctgcagagaccattgaagctctgcatgcagcaggcctgaaagtctgggtgctcactggggacaagatggagacagctaaatccacatgctatgcctgccgccttttccagaccaacactgagctcttagaactaaccacaaaaaccattgaagaaagtgaaaggaaagaagatcgattacatgaattattgatagaatatcgcaagaaattgctgcatgagtttcctaaaagtactagaagctttaaaaagtaagaaagtacatcagtttcttatatttagacattggtgtagatgtaaatcacagctgcatatacaaaaggcttcattttctgtaatgcatgattttctgtttgcaggtgttttatccttataagttaaaatcgtccctgaggacttgaataatggcccatctgagattatttggcactttccaccttttcttttaacttaagagaaaactgcacatttcggaaggtttagaaaaatagctcaatttttaaatgtttagagtctaggtattcaatgttgatattctggcctggtccatgttaagaaaaaaatattcctttcacagtctcttaaattgaatgtaataaaatcaatctttatgacaattttcatgcattttgaggttctggagccattttctgtgcatttttataccccagagctccaaatggaatcaaatacttgttaacgtggccact

SEQ ID NO: 139368 - DNA, 1058 bp, Homo sapiens
aagcagagaaatgttgaaaatgactatgtttattggatttctgtttaaatgacagtttaaatacattttagcttatttttgtggtctatgttttgtatttggggatttgataatattacttttttttatcttaatataaaacattttcctggagcaagtttcaggtcagaatttgcagccttaaaagacttttcaacaacctttgttaaaagaactgttacttcctttttctgaacctaattgaatgttaccttttcagttgtaatttcttcattttttcagactaaatatgtgtcagaatttctcttgtccatatggctaaagcaagagtatttacagagtgtgtttttttttttttccaactattattagaataactacagatctcctactttactcctaggatgggtatcggacactctgtgtagccttcaaagaaattgctccagatgattatgaaagaattaacagacagctcatagaggcaaaaatggccttacaagacagagaagaaaaaatggaaaaagttttcgatgatattgagacaaacatgaatttaattggagccactgcagttgaagacaagtaactagaaaatgatactcttattattttaatgaccagtgttttgggtgtgatctgccccagattagtaatttaatctcgaagtttgaaatctttagttttattgtttaagtggacttaaagatttatttattatagcaagtatgaaaaattacaccagattttgagctgttagtaggaatgatttttttttaattttttaattaatttttttttttttgagacagagtctcgctctgtcgcccaggctggagtgcagtggcgcggtcttggctcactgccagctccacctcccaggttcacgccgttctcctgccccagcctccagggtagctgggactacaggtgcccaccaccacgcccggctaatttttttgtatttttagtagagatggggtttcactgtgttagccaggatggtttcgatctcctgacctcgtgatctgtccgcctcagcctcccaaagtgctagg

SEQ ID NO: 139369 - DNA, 1008 bp, Homo sapiens
ttccctgtaagtgcctttattacagtatttgagaaactagaagggtagttatctcattatgctctgtctcccttatcatatggtgacccgcataagggaagggactcaggcagattcacctctattccccagcacctagcactgtgcctggcactccatacataaatgctgctaaaataattggcagagtgggactgtttctagacccctccaaatatggcttggtgggacagctctttatcttccatttttatgtggtcattctccttaccattttaagtaatatactgaggggctataaataccccttaactaacactggtgtcctctgacagcatgttctatgttcagagaaattctgagacaaaggaaagtaccagttgtgcacacaaccagtgctatctgttgatttaagatgtttaaatatcttaacatatttctgttgtgctttatttttctcagtatattctaggttttttactttgctcatttctcttaaagatatgaacttcttcacaccttaaactttgatgctgtccggcgacgtatgagtgtaattgtgaagactcaagaaggtacatgtctgaaaagcttgaatttttctctttgttgatttgtaggcttattggttgattcactctttcaggaaagagaatcatttcatgtagtagtgtaggattagtgaaagtcatgcaaagcagtagcttttgcatatgctttcatgtatttttttaagcacagatgttctgtttaccaaattgttagtgacagaacccttgttatgacagggtgtgccttttcttggtagcagaaccatatccctctgccttgggtgttcgaacaggaactgaaaggatgacttttatatggttcagggtactgaccagtctaccagtaatgtttacatgcagccacccagcatagttggatggtttgggattactagcagcagaatccttgagtatagggagttgcttgttatccctcactgaccttcctggttcccct

SEQ ID NO: 139370 - DNA, 2111 bp, Homo sapiens
cataattttttgtgctttgtcttttaaaatgtaagctcctccaagaatgatgtctgttcaaatgattaaagtctcaggagtgtctaggcattaaattaaccagagtctccctacacttgagctattgctagattgtgaattagatactgaatgaagttttttaggccatgaagaagtcactgctttggcttaggtggtgccacaataaccttaatgagttaacacagcctatagggtatgctagctgagaaccaggaactcttattaggtactaggagaatatatagcagatttgagtgttaagaatttatacgtatctgctactaagtttgttagaagttacaacattctctcacattaatatattttctccgttcactgcctagttaccgggtgatcaaattaaaaataataatcattattttgttgctgttccacagaatcgagaagagctgtttctacgtgccttgtgtttatgtcatactgtagaaatcaaaacaaacgatgctgttgatggagctacagaatcagctgaattaacctatatctcctcttcaccagatgaaatagctttggtgaaaggagctaaaaggtaaagtatactttcttatacttctcctaagaaagtgaaatcacaggaggacagaagttatttgtttttttccgtttgcttcagtgaccttagcacatacatctcctattatttaataaaaaacacaactgctttagccaaaaatttgtggaaaattcccacacctaaccagttaagactaaaaagaaaatagttacaggtaggtattacttgccttactatttatgcatgccagccagaagtctgaatgttcatactatgttttgcaaataacataacagtggccactttttgtacaacacatgttatttctgaggtgctcccagcaattttgacatcatttgagaaccgaaagtccagttttacccatgaggttcaagataattaagtggctcaaaggtcacccagtgtgttagccgtagaatcagaaacccaaattgtctctcccttggttacaataattgtggctgggcattgactttctctgttatcaacttatccaggaaaagaaagtacagttatatgttgagatcatatgaaagagaagaaaagcataaacaagcatgagttaccccattgaaagtaatcattctagaccaggtgcggtggctcacgcctgtaatcccagcactttgggaggccaaggcgggtggatcacctgaggtcaggagttcaagaccagcctggccaacatggtgaaactctgtctctactaaaaatacaaaaatcagccgggtgtggtgacacacacctgtaatctcagctactcaggaggttgaggcaggagaatcgcttgaaactgggaggtgaaggttgcagtgagccgagatcgcgccactgcactccagcctgggcaacagagcgagactctgtctcaaaaaaaataataataaaaaaattaatcattctttagagatacacaaggtcttttttattgtttttgataggtacgggttcacatttttaggaaatcgaaatggatatatgagagtagagaaccaaagaaaagaaatagaagagtaagtagctctgtgtttgatgtttgtcatttcttaaccccatagtcaaatttaagtggattcaggcagggcagcaaaggaaatgatgccactaaaaatacaggaccctgctctcccagttcagagttttatgtaaatatagttggggtagaagccatgttacatagaattgcagaaactggagtttgaggtggaaattccaatctggttcacatctgggtccagtagccagaatgagagtttgcctggaatgtttctcaaatttagatgccatttcaggtctctaacacatgctacaggaaaaatcagtgaatatatgtgaaaccttctgctatctagtgtccaagcaatcactctgggattgcaagcccaggcaataaaggcagctttgctgtaaaccagaagccttgtttggttcggaatgttcaggtgtgagcctcggggcaagtactctgatgctccagtgtcttcacatttcctcttttgccacaaagacccta

SEQ ID NO: 139371 - DNA, 1050 bp, Homo sapiens
ttcactaaaaacagataagatgcccgggtcaggttccatttgatgagactcttacctctttcagatcttcatttcagcagattccatattacctatgggaatgcagtcttcttatcatctagactatgttaatactgcagaaagtaaagtagagctttgggtaatgatctagtaaatttgatgagtgaaaagaagctgcagtcttccttttagtcaccactcctttctcccaccaaaccttgcatttctagctgtggttgtcatttagtcaaatcaagttaatagccagaccatcacttcaattaatacagtgtataagcaacttgccattgttatcagtttgcatgtatagaaacgacctaaatgaaagtgcaaagaagtcttgaaatggtttcttaggccatttagtattcagtaaaccagtacacacaaaattaagtgtaacctgttttttctttgttgagtcaaatttaagatctgtgtaactttttatgttactaaaggcaatgtcatttaattcctgttcataccattgcaagcatttgcttaacctcttttaatgtgacccacactgggattaagaatagaaagatatgtttagaacagtgcttgacatgagaaacaaaaggaagtagactgctcagctcagttggaaaataatgcagtcttttatgattagacatcaatcttttagacaaccaaatgattgtaatccatattgaaaaacccgtggggctactcttctttgtgtcgccttcccatcttgcggctctgcctaatggtggaactttatagtgtgagtatatattctgattccaataatttaagccagtagctgttattcaccttttactgtctgggatgtgtgtgtgtgctaggtattattatgaagtaaacaagaaaccctcaagtttttaaaaatatcactggggagacacacacatcagacctaactatagcaatgtgatcataatcaatcagaaaagatgtggggcagtgcaaagagtctggtgttctttgattttggtgaagtcaacatcagtgacagtc

SEQ ID NO: 139372 - DNA, 1751 bp, Homo sapiens
ccctctaccccaaacatttaggattcagggaaatggagacaagatactctttctataagggttgagtaagtaatggtgtgtgtatgtgtgcatgtgtgtacctctcctgtcactttacaggaaccttaataaggtgtgttcagctagtcagccattgcacttgggggagcattggtggtcaataaacagttcatggccagcttttccattttgccacttgaaagtaatgctgcagctatgataactgaggttaatacacaaaggcttgtgctgtagttacgcgtcgtacacagaaaaagctttagatgactcagtagtttaattcatatctgactgatgtctttggttttaaaatccatgctatcttatttttcagatctattaatgctttcctgattgtatatttatttatcttactgaccaaagctgcagtatgcactactctaaagtatgtttggcaaagtaccccatacaatgatgaaccttggtataaccaaaagactcagaaagagcgagagaccttgaaggtaatttgttttctgctgaaaattgaaactattttttgtgactgagccaaccttcactgaaatgctgctcagggaaacggcaccttttgttagcttctgaattttctctcgattacatggtggctctaagccaataaatatttaagaagatttattgtaaaagaaagaaaaagaaaaacaaagttttttttgtaaaaaaaacttttattttctttattgtaaaagaaagaaaaagaaaagaaaaaaagagttttttttcttttactttaggcatctatgcttgtttttagctctttatataagaatttaaggtgaaacaatttggcaagatgctttgacattttaatgtaataggagtatgtgaaatgtcacgataaaagcataatgaatgccttacatatgaactttgatctcacattcctatcttagggtggagtgagcaaagagaacttaaagaagtgaaaaagtactgacagaagtagtatatactgaagaataatgataaaattgagagtgttcttaaatgttctcacatactgtgataattttgactacagtgatgtagtgttattaggaagttccatctttatagcaagagcagtgttttcagcattgaaataaagatgaaattaattcttcctttatattatattggtctgatgaaattgtatgtctaattagcatgaactatctcttttattttaggttttaaaaatgttcaccgacttcctatcatttatggttctattcaactttatcattcctgtctccatgtacgtcacagtagaaatgcagaaattcttgggctccttcttcatctcatgggataaggacttttatgatgaagaaattaatgaaggagccctggttaacacatcagaccttaatgaagaacttggtcaggttagagcattgttttacttaaaataatttgtcaacgtagtgaaaatatctttttgtgtagtctggattaccaatatatgtgaccatgtcacatttggaaaagtgattcagagaaaattctttaatgcaggcatgtaatgaaggtaagcagtgttttcatagttacagcatcagttcttttgctggcatttttgagaaggatacaatttatgtattaaatttgaacgttactgaaattctccttggaactgggtgatgttacattattagctattgctttggaacaggaaacagtcttcatcaccatctataaccatttgt

SEQ ID NO: 139373 - DNA, 1040 bp, Homo sapiens
gtgtgtgtcagggcaaaatctgtccccagagttgttgatgctattggcttgtttggataagctgtgttcattttttatttaggtctttgggacctgaaaatctcttgctgaaaggagctacgctaaaaaataccgagaagatatatggtgaacaatttttaagatacacctatcaaaaaatatgctttgtaaaggctgtgaataaatagtgcatattaaaaagtaaacatggcaggtttgccatttaatttaaacctacatttaggtgttgggaatttataacgtggtaaactaagacgaaatatgacaaatactatatataattaaaattatcctataaatgatatacaactggtgagtggaagagggcctagatttcccacttttatagacttaaaaattcatagagccagctgggtgaggagttggttgacaagttcttagtttttattatattctgtaatttcttaggagttgctgtttacactggaatggaaaccaaaatggctttgaactaccaagggaaatctcagaaacgttctgctgttgaaaagttagtatgcgccacaatttatttagtcattattgattaaaatagttactttcttggtaattccaagtaacaagcataacaaaaaacaacatcaattataatagcaactacaattttaagcacttgtttatgtaccagaaactgtgctcaatgatttgtatgtctgatttggtttagtcctctgaagaacactgtgaagtaattcatgttaacctctccactttacagatgaggaaatggtcttggagatggtatgtgacttacctaagctcacatagctattaaagggcagagtttacttgaactgtaaattcattcctttttgctagtggagttaatggtttggagtcctttagttgctatatgcaagttggttctataatatagataatagtctcctggcacctattgaagcagtgcctcgtagatcctcaagccagttgccactgctatagacctcaccctgtatttggcatggataaccagt

SEQ ID NO: 139374 - DNA, 1043 bp, Homo sapiens
aggtgtgaaccactgtgcctggccatccaaataatttattgtctgccttgtaccaggcactgtgttgagtgttgggaaaattgtaaacaatacaggtgaacaacctgctcctatagaactctttgcttatcaagggagaaactttaatttaaaatgtacacatatataactcactataataagtgttatcaagtaagtatatatagggtgacatgagaacacataacaaggaacctaatttagattgggtcagagaaagcaaaggtatgagactagatggttattgtaatgcgtagaatgaaagcttcatttctgaaaaaggttttcatatacagtgcctctaaatatatgcttatgtatatgtgtgagatttcagtttcaaagtgttggacatactaaatatcactttatatgataatgtggacccataatcagtcattactattaagatttttcaagttttcttcataacagtgttcttttttcttcctcccttacagtatacactttggaattttctcccaaagaatctgtttgaacagtttagaagaattgcaaatttttattttctcataatcttccttgtacaggtaagagctccttaaacagccacttaacttttagaaacttgattgctttaaacgaattttcaatctatttctaaccttaaaatgccatgtaattaaaaaaagacattccagagcttattatgacttcttaaagtagaaacataacatttaaagattatcattttgtaaatttctaaagttgtgtttttactagaaaacctgttgagattttgtttcattgttactttctttgaaattttcatggatatcatatttttgctcatcccaggatgacgtgtattgtgtaccattaaatgaaatggaatatatcaaaactgaaaatagttcaaactagtagttttattttgttacataccagtttcagcctaattggaaacttctcactcatcttcctgattaccatttttgctctctctcattcatttactcactgtaagggtgagagcctagtta

SEQ ID NO: 139375 - DNA, 1753 bp, Homo sapiens
gtgatttttaatttttaaacgaagaaataattttccacataccatctacataagatgcacaaattcagactggagtactttcagacattgtagataattggaagactacaagttctaagtagtcttgcttaaaatgattactttgagggtgggatttatacctttgacctttaaatagatcactgaaaggaaggaaaatctttgtgactacatatattaaaacattttaggttggggaattatagttctaaaaaataatgggaatatataaatgggtatttgtttctgtcatgcatcctttgacttatatatgtggtagtctcagatatggtaatatagtaccatacaaggagactgtcccaaatttatataagaaaagggtattatcctgattaaagtgaagagagtgaggccttagcaaaattaaagggtgggataaaatagagcccaatcttgaaacttttaggttcggtgagtctacttattaaaaatgtaaaaggggcatgagaaatatattgtgtgaattggaactttacaacaatgaggctctgagagattgcaaaataaactatcctgtaaagccaaataactagtttctttttagaaaaagtcgatcatttcttcaatagaggcagccattctatttctgacctttacacttatacacaattattttgtgtttagaagtaatctgcattatgctttctgttctctagtaaggtagttgaaaggttgtcctcagtagttgcataataaatgaaatattcccagtccattctttcgtgagttagtgtgttgctagtgaaggttatggttaagattcatttgggctgtggatgaaagaaaaatgattggcagtaaaaatattgtttctctagggtactttctttaatcattttagaattgcactgttgacctcagaacagttggttcaaacagcacttttactaatctttactatgtcagcaagtaagagcttaatggattttgaattccctaacaaggttttctcctctccctactactttctcgccagattatggcccagcatgcttggacaagaattatgggcttggtagaagtgtggacaaatgtgatgaaaaactgaattttttcccttttctcttggtcagtgtgctggagaagagaaacgagttggcacacgcacagtgtttgttggcaatcatccagtttcggaaacagaagcttacattgcacaaagattttgtgataatagaatagtctcatctaaggtaagtttttgttttaactcaatagatgttcatatagtgaatcagataatgcattctaatttgtgcttctgaggaaactgatgcatttatgtatgtgtacatgtatttgcatgtatatggatcatataccagctataataagtattcctctgaaagacagtttatttaaaaaatcactttgtcttgttataggtgaaagatcattcacttgccttccgttatgattcacagtgcttgttgattatgcatattactttaaaccgtaaagtttgctaaaaatacaaattacttacttgtgcaaagcttcctgaattacccttgaatggatgaactaggatataaaagaatgcaaattcttttataaaagaatttgcattcttttggagaatgctgtcctggaatgactttatttgcatttctttctagttcccctgccaacccctccacctcccatcccacttctcaagtattaatagactcctacgtcccaaagggtgcat

SEQ ID NO: 139376 - DNA, 1199 bp, Homo sapiens
tgagatatctaaatagtgagaaaagtcttccatccctaagggacctttccacataaaccatctgcttaggcctttgttgcatatatttttgaagcttgaatttactgtattacagtgactcttagggtggagaaactgtatcatagtgaatacttagattatgtctcttcctcttaaactacaactaaaagttcaattcaactttcctccgaagcttattgtttagccccactttttattgtggtccatttattgtaggcagggattagaaaagaacttcccaagatgaggaaaaattactgtgtggtgtaagatactgatatttaaaataataacaccttaaaatacagaagttacaaaggcaaatcaggtctttggagaagaataacaaaaagatatgaaatggtgcaataatggggctaaggccgccagagtactgctttgagctcttaaggaatagactgtcatctgatgcttcctttgctgcctcccatggaagtacaggaactaggcaagccataattggctcacttcccaagttctgggaaactttacaaggatcacaggggttggtacaagttgcttgataatctgcagcattctctctgagatttagctgccattgtgttgccaaatttctgcatgtcagtatgcagatggtcccatctctccctccagcctctgaggtttgtaatctatatttatttctcctcttttcagccaggttgggttttgaggtcttggggcctgctttattcctgctttttatttgcatgtatatttttatccatttcctgagggtaatcgtaaatggttagctggattttcagcctcactgctcctatctttaagagttaagaatctccttatttagagttttaaattttgttaagtgtttggaatgaaaggctgtgtgtagagatgggtagggtgaaagtgaaagggaacttctgaggttttgtatacttgctggttaagtttctgtgcatattgtcaggctttgggttaggaaagattctgttaataagggaagttgagttgctgagaccccaaaggaacactgagagtcgcaggttacttcctataaatggaagaacctgaatcattaaaagataaaattcctgttagaatcttgaatcacagaatgtttacagtatttttgatccatcaactttctattagcaatcctttaatgaagc

SEQ ID NO: 139377 - DNA, 1124 bp, Homo sapiens
agaagtgttatctagttagcgtggcatagttcatttacaaaactattcatggtcattttgattttataaggtttctctctgtttctgtttcgcaaagactgtatatatgttttttagttaaacaaagttaatgttaatttctttcatttgtgctccctgagtttcaagtgtaataaccctgcagatatatttcacctatttgtattagaattatatttttttccatggacatcagttttttttttttttctttgtcagaagcaactagttattggcagcaaaggaatttattattccattgtgctatataacacaactaacaattttttttcagtatttacaatatgaaggcactgtttcataattgctttataagttgtcatcaacataatcaccccctttgagactggtgggaaaactgagacatcacatggttaaggagcttgccccaggttacataactaataagtggcagaaccaatatttgaacccagatatctggctgtagaactgatacacatagccagtatgcttctgttcttcatcatcccttgtacaggctctttgaaacaacctggtaattgccatgctctatgaaaaaaggccattaaaattgcaaatattggagtacctctgatttttgagcatcaaaaatatacccatcagaagatattcatgagacagttaaacattgaggctccaaccttgtttatactatattttcatctctggtcatacataacttgatgacccttggtgatctcaaatgactctaaatgatactctgattttggggctaggcctgtttaatcaaatgagtgagccatatctgtttgtaattcttccatccatccatctttccatctgtccatctatagaattcttcatctgcacgtaacagacacttaggtgttacttatccttactgcagaagaagtcctgttgtatcctaagagaataagacacagcttcaagaatcactggctgatcaccttgaggggaagccagtttgtaagggttcgccaattttatgtatctgcagccttccatatgttacagggactcttaattaagctgctgaatttggcattagttgaactttcagtttactttcaaggagagtc

SEQ ID NO: 139378 - DNA, 1048 bp, Homo sapiens
gggaaagtgtagatgaggactggtaagggctttgagaaactgagggtagagtcaaaagagtagtggtctttagctgagtgcagtgctacatgcctgtaggcccagctactcaggaggctgaaatgggaagatcacttgagcccaggtgttcaaggctgcattgcacatgattatgcctgtgaatagccactgcactccaacctgggcaacatagtgagacccctgtctcttaaaaaaaaaaaacaaaaaagagagtagaggtcttaaagagctatgtagtagaagttatggagctgaaaaatgagagagggctattatgtgtcagggatgaagtaatatgtgataacagatcctactctctcactatagaagaggtaggtaaaaaagagtggaggtgaagatccttaaagcaaaggagttttgggactcagcaatctaggtttctggattggggtgggtgttgcatgtggatgatagaattttcaagtaccatggcaagtgttggcatagagaacaagtttgaaagccaaatttcaaactcttcagccaatgggcaataagtgaccagagaccggtgtttgatagtgatgacaacggatggtaaaggtcactacagataagaagtctgagaactataagatggtgtgttcagatttcatcagatgatggcaggagatgagatggagaggccaccagtgacccaaatgaatgaaggcacacgtccaaggagatggatagatgaccatgatgaggatgggtaaaagctggtatctccagatgatatcaaactaaaggaatgatgccatgagtatggagtaatagactctataagcaagggggaggcaagaggaagcttgcttattgccctctgagttacatagttaagaggttcacagggggaagaattttaagaagacagccaagtttcaaggaatgtgggtggttgtaaggtagggtttctgatgttaagatatagagagtttgattaacaaggatggcaggttctataggacgtagttttttttttttttttgagataggttcttgc

SEQ ID NO: 139379 - DNA, 1068 bp, Homo sapiens
agtaaagtactaataccagtgcttcctcatgtatactcggttgagtttcttttgggggtgatgaaagtgttttagagttagattgtggtgatggttgcacaatgctgtgaatatgttaaaaaccatggtattattaaatgagtgaattttcatttagtatgtgatttattaataaagctgttttatgaaaagggtactcatatcactatgaatcagctctatcacttagtagctggctgtgtaataaccttggattaagttgctttcatttttttgtgccttggcttcctcatctgtacaatggggataataatatcttttttgttggttggttgtgaggactaaatgaataaatacatgcaaagagcttagaattgttttttgaaacataaaccctcaaacgtcagtggttgttattattcttatattgcatgtatagttcagaagagaagtctggggctgtagatacacctttttggtgtgatcaacataaagatggtaattaaagccacacatgtggattaggaaacccagggagaacatgtagaatgatgaaggacagagagctgagagccaaatctagagaaatagcatcatttaatatgggagcaggacaagcatatctggcaaaggaaactgagaagtcatgtccatagaggtgagacaggtgtagtgttagggaaggaaaggaaaaaattgtcttccaagaaggagaatatggctaatagtgtcttgctaaagagagtttatcttagtctaatttgtgttgctctaacagactgggtagttcataatgaaaataaattgatttcttaccgttctcaaaggccgggaagcccaaggttgaagggcctgcatctgccgaggtccttcttgctgagttgccccatggcagaaggtggaagggcaagaaagtttgagagagcaagagggcaagagcaggagggagccaaattaatttttataacaacccactctaacaataatctattcatgagggcagagcccttatggcctaatcacctcttaccatcctggtcccacctcttaataccatcatagtggcaa

SEQ ID NO: 139380 - DNA, 1012 bp, Homo sapiens
gtaaaatgttcctagtttctactctaactctggagcagtatttgtatgtgtcatcaattgtttaaatttgaatcaagcatcagtaatggcataccatttgggctgctttgtggccctgatgaatgctattttattttatttattttttattttattttaattttgaggcagagtctccctctgtcatccaggctggagtgcagtggcccagtctcggctcactgcaacctcctccccctgggttcaagtgattctccttccttagcctcccaagtagctgggactacaggtgcgtgccaccacacccagctgatttttgtatttttagtagagattgggtttcgccatgttggccaggctggtctcgaactcctgacctcaagtgatctgcccacctgggcttcccaaagttctgggattacaggtgtgagccaccacacctggcctgtgaatgctattttaatatagttctcaggaatgattaaaaacaaatgtgtttttctaagtggtagaattaatagataaaatcactttgaaattaaagtcctcaggtaacatagaattcttttccctgaacaagtcattatgtagcacatggtataattttggcagacccaactttattaccaacaaaactgtaaagcgagtcctatgtcctgtttgtcttttcttctcgggggtttctgttcttactagaacaaatcaaagtacagtgtgtgttgctggtcttcaagaattattagtttttgttgtaactgtttaatgcagaaacagatgctagagcagttattccccaaggcaccatgtgcctaaggcatttttaaagcactagtatgttttcagtgtgatactgctactctggaagaactgtatacatagtggttcacttttccagtgtggttagaactgacatttctaagatataaagaaatttaaggccaatttggatttgtactctggctctgcttcctgcttaggtggaagactttgagtgatttagttatgctctctg

SEQ ID NO: 139381 - DNA, 1054 bp, Homo sapiens
actcataaatctggtttttctgtattccctttctaggtgataatgtccccatttactctgtcatttaagcaatacacctctaagtcttttcagttctttttttaatctctcttaactccttctcctcttccattctcatggctgcagctttggtccaggccctcaacagttatcacctaggtaaatacagtcatatgtgccccagtgtagcttgtccagccttgcctcttgctatctttttcctcatatgtttttcttcagcaataggtgaactccttgtgggtcactcagtcaccccattccatctcctgcccttgggcctttgcgcatgctagctgctctgccagatcctccctcttacttcttagcctgtttaacccctactcatctttgaaaggcttgcttcaggcatcacatctaggaagtctctgctgacccctgagtttgggcttaggcactctttttcctcacacttgcctgtagctcctctgatgttatattcaccacactgggttataatgatctatttgggtgcctgtcttctcttctggattgtgaattcttggagactgcagccatggggaaatctattgcatttttctgtgtgtgaatgggagtggggtctctcctttagtcataatgtgtccttctcagggaggccttcctttgtaaccctatctaaaattgcaacctcccccaacacttcctatcccccttccttgatttattgttctccttggcacttattgctgtctaccatactatagattttacttatcttgtttattgtctgtctcctcccactagaatgtaagcgctatgagggaagggatttttgtctttttttaaactgttgtgttctcactgcctaaatcataccaggtatgtagtaggcacttagtgaatatttgttgaacgattcaacaaattcagctgcctctgatagtaaattttgttttgttttgtttttgaagacagggtcttgctctgtcgcttagtctggagtgcagtagtgcaaacacagctctctgcagcttcaaactcccaggctcga

SEQ ID NO: 139382 - DNA, 1058 bp, Homo sapiens
tgcctcccaggttcaagcaattctctgcctcagcctcttaagtagctgctattacaggcacccaccaccactcctggctaatttttgtatttttagtagagacctgtttttgccatgttggccaggctggtctccaactcctggcctcaaatgatccgcctgcctcagcctcccaaagtgctgggattacaggcgtgaacccccatgcctggcccatcttaaccatgtttaagtgtactgttctgtggcattaactgcattcacactattgtgcaaccatcacaactctccatctctagaactcttgtcatcttgcaaaacaaattctgtattcattaaacaataaacttcccgttttcttttctccccagcccctggcaaccactgttctactttttgtctctatgacaaagccaatcaatttttgtgttaagtgtataccattaatctctacagccagtagctttctattgaattttttagataaaaaaatttacaagtcaaaccaggatttataaacatatactcagtattgaaacaagaagccatagacattttaaatagaatttagcatgtctttaaaaatgtgtaattgtatcttttaaaggacttgaagtctgctccactatgtaatacaactagattaatatttgataacttacacataagaaagctgcactgaaaggaaaaacaagccctattgctgggtggttcctttatgcttgagaaagcagtttctttggaaaataaatacatttgtgatcacatgaattaatgcaaattgctgcatcaggctaaaaatccattatgctcagtaactttaatgagattgtacattttgggatgctttggacagagcaaagcaatacatattaaaagggctgattttgaaagctgaagccccacttttcctcctgtcaattttttttaagttgaattgcctacaggttactaatatttagaaagctgatttgcgaagctggaaaccatcattctgagcaaactatcgcaaggacagaaaaccaaacaccacatgttctcactcataggtgggaatt

SEQ ID NO: 139383 - DNA, 1037 bp, Homo sapiens
gtctcagctaatggctcatatgtatttagtattcagtgcagctgaactgtaattctgtaatggaatttgaccaattttgagaagccagtttgtaatgtatgaattagtggagacccatacatcttgacgtttgctgactctgccagatgttggttatatttctgatggaaagaaacagagagctggctgggatcccaaatcttagaattgctaccggccgcctaccactgccacatgttgcagtggtaggagataaacatgctgaggataagacctgaaaaaaaatcactctatatcagcaactggagatacagcccatactccttatgaaatattctactctcgtggcctgggttgaaccatgtatgaggcaggcactccttttagcccaggcccaagtctgctctatgcagtcttcctcatatcttgtttccctagagttaccacttgaaggcattccttattcgtaatgtggtgatgattaatggcacctacctcatgggcttgctgtgaggtttcaatcagataatggatgctgaaggcttagactgtgcctggcatagagtaagtgctcaataaatggtagctagagttcttttattatgcaatagaagcaggactctgagggtaacatcttaatatttccagttgaatgttatcaaagtcagttgttcatgcatttgttaaattatgggccatagcaacccaactctatggacctgggctgctgtgtcccagactgtaattaacacacagttgcttatatctgtcttttcttccaagtgaggacagtttgttatgacttgtagattaagcaaaattacttgcttctccattgtgtgctaacctggtgtagaataccttttcttgtctgtcttatttaccatctctcttactttcaaatttctattataattctcctttagattacatatagctaacttaagaaagtcccagatgtgaaaataaggcgagtgcatgatgtatcccccttcccttgatttttgctgatcaggtggggaatctgacccaatagc

SEQ ID NO: 139384 - DNA, 1167 bp, Homo sapiens
tttgtaaatgaaaataatctggttttagaagatggcaaaggagacttagaatgatttctatagttgtttgtttagttcttttgacaaaattgcctaaagttcttttataaaaatggaattcattttgtctacttttcactccttctcaagtcaaaataacacaaggtatttactaaatcagtttgcaaatttggaaaattttaaaaagtactgctgagctgggtgcagtgactcacgcttgtaatcccagcactttgagaggcccaggagggaggattgcctgaggccaggagttcaagaccagcctgggcaacatagcaagacctcatcaaaataaaaaataaagtattcctgaatgctctggacttgcctactggtttggaagtggttatctcagtgtggaggattggagatgccgtttttattttacatggacaacagaccattgctagctaactttagtcccttagcccatgtagatctgacagtttatgacgtgagactgtcttctctaagtgacacaaaccatttcaggttgtttcagtaaggttattttgggtcttacaagcagggcccaagagcttctgtgtgtttcattagtcaagtcagggagatgagaatgagtctgagaaagggcatcagactatcagtgccttggactttgggagggctgttggctccaactctaccaatcaatagccttctgggaattggttcatatgattatttgatttcatagaagtactcttccagccaaaagtgctgcttgacacatgaaaattgtatcttgacaatttttggataataccacaccatcccttgatattgttgaaaatcagaattggtaatcagtatgctttccttctagccatgaagtctttaagtaaatatgttaaacttagagttttattgtagactttgtggttaattatgacctttcttagcaagctgatgtcacaatgtaataagtaagttatgtttctcatatttattcagaagtccaggatgtctttgtgttagggtgatatttaggttttgatatcttcgatttgtctattttccccaattgtatattcagtctgtaaaatttattttactcttttccaattacagtggccacatcttcttatttaattttcaccttactttgtacatcattttagggta

SEQ ID NO: 139385 - DNA, 1145 bp, Homo sapiens
attaaaatgaatattttagtgaatattctggagcacttagttggaacctaacgtatttgtgtaaatgctcctgtgtccacctgttgcccacatctactcatccccacgtctactcatcccccagcctccaagccttctctgtttgcctgtagctcctggaatctgattgcctcatagctaaaacctttatgaaaacatttgggtagagtagcccaggatttctttgcttggtaagaactcacttgctaaaatggtttttattaaaatatgtttgtgcttcactactgtgcttcttttgctagaatagatgcagccctaaagatttgcttgtcttcctaattcctttcttaatacctcatagtagtgactgagctattgatctgaagggataataacagccctacacgtgctttttgcaggttctgatatcttaagaactaaccgagagctttgaaaaagaacattgccttagtgacataaattcaagcctgcttcaaaccaaataatatacagcatgtgtcataaagaaggttcattcctagaaatcatcatattcaaaaggagcaaaggatgaggaagaaggaattacagcaagtgatagtacttgctcaaagactgttaaccagggtcagtgccatgggaacattgtctccagcagccccactcactctctacccaccccactcctaattcatatccctggctgctgctgctttttttttttttttgacacagggttttgctctgttgcccaggctggagtgcagtggcatgatcatagctcactgcagccttgacttccccgttcaagagatcctcccacctcagcctcctgagtagctgggactacagtcacgtgccaccacgcctggctaaatgtccctggcttctaacatgcacttaaagcacttctcagaaagactgtcccagtagaaaaggtgcacagaaagtaaacaattcactttttcttttttcttttttttttttttgagacagagtcttactctgttgcccaggctggaatgcagtggcgccatctcagctcactgcaacctcctcctcccaggttcaagtaattctcatgcctcagcttcctgagtagctgggattataggtgtgtgccaccatacccagctaatttttgt

SEQ ID NO: 139386 - DNA, 1053 bp, Homo sapiens
atttttagtagaaacggggtttcaccgtgttagccaggatggtctcgatctcctgacctcgtgatgtgccccgctcagcctcccaaagtgctgggattacaggtgtgagccaccgtgcccggccagcagcttcttttctatgaggccatccaccattccaggctgtgttggtcaattctgtctttcacagcatttgatttttaaagttccagccagcatgaaggaaagggagtccaggagaagcttctttaggaaggtgacagaaactttcacatattacttttgcgcacatgccattggagaaatcttagtcatgtggccctccctagccacaagggagacagggaaatgtagtttctggttggaaagtgaggtgttcaggaagaaaggaagaacagatttgggaggacaatccagtggacagggagacaggcagtaaacaacataattgtaatatctcctgtgatgagtgataaaggaaagataaagcagagaatgatgatagaaagtgtcaggggtgagggttgcagtttttcaaagggtgaagaaggcctcactgagaaggtgtcatttgaataaatccccaaatgaagttttgtgagcaagaaataccattttgggttgttatgaagcctataagaatgcatggttggttttaacatgcttgagtctaggaccttatcagaccccatcagaaagtagttagcgtggaaagacaccattgtgccacatattcacctactgcaagcaatacaaggccttaatgaatttttgttgttgttgttgttgtttgttttgtttttttttttgagacagagtctcactctgttgcccaggctggagtgcagtggtatgatctcggctcactgcaacctctgctccccgggttcaagtgattctcctgcctcagcctcctgagtagctgggattacaggtgcctgctacggcaccgggctaatttttgtatttttagtagagacggggttttaccatcttggccaggctggtcttgaactcctgacctcgtgatctacccgccttggcttcccaaag

SEQ ID NO: 139387 - DNA, 1019 bp, Homo sapiens
tatgtcctaggatcatgtgaagatgaatgaacaaatctaaagtgtctataggccaggaatggcagactctactataaataattgtagtttgctagacttcccatctgtaaaataaagggcttgggctgctagatggtctgtaaggctcagtgaatcctagaactattaaagaaccttagaggccatttagtagtccaacatcttcattatagctgggaaaatggactgagagagggtaagtggcttttccaagattattcagtgaattgagaattcagaaatatggaattccaggctcagttctattgcccttgtcttcagtttccttatctgtgaactgcatgggctcctgggatgatatatatctaagttatttcccagctttataattctgtactatgtgtttaggcttagagtctacgagtgagcgaatcttttgactattttctgttgggtttttatctgttttactctttgggtctccatctcttgattgcacatttgacggtattctaccccaaatttcagtttcccctttaatagtaatgagtttgaactgaattttatatactttggatgggaacattgacaaattttaggaagtactgtttcactcgcgtccgtgtgaagagatcaccaaacagacttcgtgtgagcaacaaggctgttcatttcacctgggtgcaggcgggctgagtccaaaaagagagtcaacgaagggagataggggtgggactgttttataggatttgggtaggtaaaggaaaattacagtcaaagggggttgttctctggccggtaggggcgggggacacaaggtgctcagtgggggagcttttgagccaggatgagccaggagaaggaatttcacaaggtaatgtcatcagttaaggcaggaacaggccatttaaatttcacttcttgtgtgattcttcagttacttcaggccatctggatgtatacctacaggtcacagggggatatgatggcttagcttgggctcagaggcctgacactgt

SEQ ID NO: 139388 - DNA, 1057 bp, Homo sapiens
ccacctggtctctcccttgacaggtgggtattatggggattataattcaagatgagatttgggtggggacacatatcaccctcataaccagttcatcacgacaccatgcttagtcagtgccacttttctttatcatcatgactgccaccctcgtctaagtcattagcatctctccactttcatatttgttcctcctccagttttcccgttcagtaaatggcaccatccccctcctagtagctcaagctaaaaacctagcagtcatacttaatactaacctttcccttcatcacatttgtcagagaatccagtaggttctatttctgaaaatgctgtcacatccatccacctttcttcatgcccacacctaccaccattcaagtttaagctactgctgtcatttacctggacctttgcaattgattattttattatccacctttgccctctcctatctgtcttccacacagctccagggggatcttttacagacgcacaccaggagcacttcattgactttcgactgatttctggttaaatactttgctggtattgctctctctctttcactttttttcattcacttttaaaaactgagataattcacctaacataaaattcaccactttaaagtatacacttaagtggatttaaatttcctatgctgtgtaactatcacagctatctaattccagcacatttccactacctcaaaaagaaaccccatccgttagctcttagtcccagtcctctatccttcagcccttggcaaccacccatctactttcttatctctggattgccagtggaatcatacaatatgtgttcctttgtgactgaattctttggtgtagcatagtaatattttcaagatttgttcatgttgtagcatgtatcagtatcagtacttaattcttttttttttttttttgaggtggagtctgtcacccaggctggagtgcagtggtatgatctcggctcactgcaacctgtgcctcctgggttcaagcgattctcatgcctcagcctccaaagtagcttggactacaggcacgca

SEQ ID NO: 139389 - DNA, 1051 bp, Homo sapiens
atcttcccatacatagatgctcttttctgaaacctatgactccagtaaatttatgtcatttaaaaaaaatgcatatatatatatatatatatatatatatatatatatatatatatatttagagaaggagagagagagagagacagtcttgctctgttgcccaggctggagtgcagtggcacaatctcggctcactgcaacctctgcctcctgggttcaagtgattctcctgcctcagcctcctgagtagctgagactacaggcgtgtgccaccacacctggctaatttttgtatttttaggagagacagggtttcaccatgttggccaggctggtcttgaactcctgacctcaagtgatccacctgactcagcctcccaaagtgctgggattactggcgtgagctgccatgcccggccttatttggtgcagagacagtaaggcagagaccaggatgaaatatatatttggggtaatatatcatgacactacttcatatattattataggactgcttacttagttaccctgcttaaattatgggtacacatttctggtaactttcactacacatgggagacaggatggcagttcattttcttgagtactagtggtcatttatttaaaaagctggagatcaggccttttttcaggagcacattccttaccaacacatttatagttcactgctattagataagaaagcttttgatagactttcagatctgactgcatcattcggacttaccagaacatgaattgcatctcattccctctgtattagtctattttcatactgctttaaagaactgcctgagattgggtaatttataaaggaaagaggtttaatggactcacagttccacatggctggggaggcctcaggaaacttccaatcatggcagaaggcaattaggacgcaagacaccctcacaaggtggcaggaaggagaagtgccgagtgaaggggggaagaggcccttatgaaaccgtcagatctcgtgagactcactcactatcacgagaacatggggaaaaccacccccatgatt

SEQ ID NO: 139390 - DNA, 1041 bp, Homo sapiens
ttgttccttttgtttatgcttattgctaataattcagccatttagtgagtaatattgagtgcctatataccaggtagtttccagtgttcctaattaacttttagctgaattgagatttgggcaggtgaagctggccatttttatattgatgcaactgttcaaaagagcttgttttttcaaaaagctgccagtttaccacctgctgagcagtgggttctaggaggtaaaggatggccagtggcccctgaaagaaccataactaaccttgctgtgtctgcatgatgtgcaaagaactagcccactgagtgaaatcaaatactggtttgttgagtgatggaaaaaatcaaggctcattgcttgtctaacatggttattcagttctctcaaagagggtgaatgcatgggatataaaaaaaaaatactatttttttcttcaaggtggtggaatttcctgtacatctgtagtgctttatacagatgaaccttttacatctggaaccctcgagactgggggagtttttctggttaggtggagggaggttctgggcttccacaaatgaattaggtgctggctctcgagtttatttcctttcacttaacatttaccttcttggcctggtataagggtagattagcggtgatcgtaaaacaaaacatactggcacaactgcagcatatgttaacactgctgcagcttaatgatgaatgagtgctcagcactgcagatatgggcacaggatgccctatgcccacacattggcagacagcccctcaattattgcagtgtatggacggattactgggtcggctgacttcttgataatagaagatgtgatttataaatgataatggaccgtggatttccagatttagaaggttaacctgtatttgtgaagtagaaatcattgatttcttgtgccatatgtatttaatggaatatgggaggattggtgatgttgatgatattgctgttcaagcagatatcatcatttgttttttagacgtctctattatatgttgtcataaagtattaatgtggca

SEQ ID NO: 139391 - DNA, 2430 bp, Homo sapiens
ctgagaatgcaagcgggtattgttcttaatagctgtttcacatagattcttgtgatcttggagtgttgcgtgggggtgacaaaaagggaaaggtggcaatgaaagctaattgtatttaggaaaaggataatcttttcacgtggcactcttatggtggaaaacaactgggctctgaatcataataaaatcattaaacttaagttgttgaaatcctttttttttttttttaaggatttgaacatttgaaaccgaacaactcaagtattggtctaaaagcccattgcttcccttttgcgaaaagtgatctgcatcgtatcagagtctagtaattaagcagtgctggcccaggaagccagggcatgcagtagaatttgcagcagttgttgaggtgccagcctgcaggtttgaggctagtactttgcatccccgaccaagatctcagcagagaatcacttttgctaatactgaaatgagctttgaccttattgttgcagctggaatattcagctgttcacattttcctgcgcagccatgactgtggtaagtatcaggaatttgtaccagtgcggtaagctggaaggttcttaggagttgtgtctgagccctaggcccagggcaaggaattaatctgcataccgttggactgaatgtgaaaattactatcaaataatcattgctaaaaaacggcttcaaaatttgggggaggggggcaatttttccatctcttagatcagtaaaccatgcgctgttctcctcttttgcctgacaaattctttgaggggtacttccatttgaattactagaagactagaattaaagatttgagtggaactttgagactttcacagcagtatagatgtagtcaaggttgtgagttgtcttatgattgttttaatattttagaaatagagctatgaattcctttcaaaatgagttgtttttttagtgtacctgtacgtgtctgatattggttttgattgtgaaataaattacagtggtgttgattgtagttgttggttattgaaaactagactacatattagagaagtgcttcctttatattttaaacctgacgtggaagaatcccttaggattcttacaagcatcatcttctatagctcagttgtgtttgctgaatcatttttgaaatgccatttatttttcgagttttccaatttcaagctaaaagaaaatagtgattcattgtatttttttaaatacatggtcttgacttctttgccattaataactgtgttcctttctttctgatgaattatgactttccttttgacagttttgaggtggaaagaaattggtggatttggtgtatagcattttagggttgaggcatgtagagggtgtcctaaaggatttaagagttggatgtctctgagtgcaataaaagcaccacctgttctcaagtcaacatctccataaatacagtaaataagtaataataactctgtctgtacaatttattttcttcaaaggcatatttaatcagaagtctggactagttgagatttaagggtcatggacttttatgttatcctgtcttgttttattcttaatgcaattcctagtgactatagtaacgtgttctcttgggtttaaagatttattgaaagtctaaaaacaattcccccctctttttggcttatgaaattattttatactaaagattcaaaataagagatttcttgataaagtaggttgggggcttggtcaagaggatgctgtcagtttagcttgtcagtgatagttaacaggtatgcatttctagacctttgatacatgaaagcttaattgtgagtgtgaaatactggagtacatttaaatctctgattctagaagcccttaaactgctttggtttcataaagcatgtagcatataatcataatatcacacagaagatgcccaggactaggaagaaattagactgcataaggaagaatggaaatttaaaataagactaaaaaatacaaaataagaattaatgaaataggtagctaatttattgctttgagtccaaggcaaggctagtctaatgaagcaatatatggaggcaattaagaaaatagttcaggtaattgctttgttttttccccaggagcaagaaggtttttagtttcccctttaaactatcagagtaattaaacatttttttttttctgtttcactttactaataatcctggcctgacattgacgagcgggaaaatattgattttattttactgtgtttagaaatatatctgtatgtatgtattgcaatatttttacatttgcacaactattacaaatggtctgtgtatctcggctcccacatggctgttcatagaggtctaggtttagcagttgaacttgaccatacttaaaagcaactttttttttttaaatcatattgtgttataattgccttttaacttg

SEQ ID NO: 139392 - DNA, 1052 bp, Homo sapiens
ccctttgtcagataagtagattgcaaaaattttctcccattctgtaggttgcctgttcactctgatgatagtttcttttgatgtgcagaaactctttagtttaattagatcccatttgtcaattatggcttttgttgccatcgaaaagcatactatcgatactgaacttgaattggaagaggcgagtctggtctcaaaatggaggtaaaaccaccgcccggtcgcccccagcccaactccggccgtcggctgtcgctgccagagggaggagggccatgatccaaaggaaccagagcagttgagaaaactgtttattggtggtctgagctttgaaactacagaagatagtttaaaagaacattttgagaaatgggacacactcacagattgtgtggtaatgagagaccgccaaacaaaacgttccaggggcttaggttttgtgacttattcttgtgttacagaggtagatgcagcaatgtgtgctcgaccacacaaggttgatgggcatgtagtggaaccaaaaagagctgtttctagagaggattctgtaaagcccggtgcccatctaacagtgaagaaaatttttgttggtggtattaaagaagatacagaagaatataatttgagagactactttgaaaagtatggcaagattgaaaccatagaagttatggaagacaggcagagtggaaaaaagagaggatttgcttttgtaacttttgatggtcacgatacagttgataaaattgttgttcagaaataccacactattaataggcataattgtgaagcaaaaaggccgtttctaaacaagaaatgcagtctgctggatcatagagaggtcgtggaggtgggtctggcaattttatgggttgcggaggaagctttggagatggtggaggtaattttggccttggtggaaactttggtggaagaggaggctatggtggtggaggtggtggcagcagaggtagttatgggggaggtgatggtggatataatagatttggaggtgatggtggcaactatggcagtggtcctggttgtagtag

SEQ ID NO: 139393 - DNA, 1361 bp, Homo sapiens
ttgcattaatcaatagctgcactttttgcaaactgtggctatgacagtcctgaacaagaagggtttcctgtttaagctgcagtaacttttctgactatggatcatcgttccttctgtggcagatttttacagttcctctaatgcatttgggacgactgtctcaaagtaacctgcagctttcctgacaactcctcgctctctctctcctgctaagaactgtagcccttttttgctgtttttagaaccttctgctaccatatccaccacttccaccaccagatccataaccaccaccatagggactgcccgagtgtcttccaccaaaactgccccctttcatgggtccataatttgattgctgttgtccactataatttccaaaatcactatagttcccaccaccaccatagttaccaccgccaaaatttcctccttcattgtaaccatcatatcctccaccacctccaccatacccaccaccttggtttccatatcctggtccaccaccgccatagccccctctactactacaaccaggaccactgccatagttgccaccatcacctccaaatctattatatccaccatcacctcccccataactacctctgctgccaccacctccaccaccatagcctcctcttccaccaaagtttccaccaaggccaaaattacctccaccatctccaaagcttcctccgcaacccataaaattgccagacccacctccacgacctctctatgatccagcagactgcatttcttgtttagaaacggcctttttgcttcacaattatgcctattaatagtgtggtatttctgaacaacaattttatcaactgtatcgtgaccatcaaaagttacaaaagcaaatcctctcttttttccactctgcctgtcttccataacttctatggtttcaatcttgccatacttttcaaagtagtctctcaaattatattcttctgtatcttctttaataccaccaacaaaaattttcttcactgttagatgggcaccgggctttacagaatcctctctagaaacagctctttttggttccactacatgcccatcaaccttgtgtggtcgagcacacattgctgcatctacctctgtaacacaagaataagtcacaaaacctaagcccctggaacgttttgtttggcggtctctcattaccacacaatctgtgagtgtgtcccatttctcaaaatgttcttttaaactatcttctgtagtttcaaagctcagaccaccaataaacagttttctcaactgctctggttcctttggatcatggccctcctccctctggcagcgacagccgacggccggagttgggctgggggcgaccgggc

SEQ ID NO: 139394 - DNA, 1043 bp, Homo sapiens
aaaaagaaagagaaatattttgtattttttaagtaaacttgtgatctattgttgatcaaccatattagcagtggaaagcatttactcagttcaaaagaaaggaaaaattaaatatatatttcttgctatgagtttctttttgggggaaggggaacaggaaacaattttaattgcttaattctgcttttctcaatataaaaatgacactcctctcattccctgggccttcatactggaagacactatttggtcatttcaaattcatcgtggacttctgacatattcttctaagttgctcaagtttaaacttttaaaatttaattcaatagttaatagtttaagagttttttttaaaagccatttttgaggttgatacagaaggaagtacagggctgcacagttatttgatatattcaggcccactctaacaacccattctaactgttcagacagaggcagatgtatttttttctctcagaattctttcagaatgacctcataattgggctgcccctgtaggctcagcattgaagaataatgagtttttgaaccgtgaggaggacatgttttgaaacagaagcaaatagtgcagattatttacaatgctgtcatcaagggaatctgtgctagaatggcttgaaatgctcctgggactgaagctgggtatggccattgcaaagagtccagagtggcaatggctggcttttcctaactcttcctgattccatttttccttcacatcagtaacacgctaattgttgaacagcagagaggccagcccaagctgattaacagtctggcttagtgacaatttagttgagttccatttcttctaaatgatccttcagttgttcagggaaaaaacaaagacacagggtaaggtatgtttgtgttaccttattgtaacgtacacataggggcatttctgtagccaaacacaggaagtattaaaactttagtaacctggtacctcctagactcttttcactcatatattccatgaaaagacatgcagatgctttctgacatttttactcagtgtc

SEQ ID NO: 139395 - DNA, 1225 bp, Homo sapiens
aagaacttttaattacattctgagatgggttagcattgaaaggttctgagcagaggagtggtatgatccgacaagaatggaaggaagggggagcattttagaggctactctattaatataggcaagagatgttagtggcttggaccgaagtcccaatgatagggctggggggacagagttacttttcagatataagttgaagacagagtcaatgtgatttttaatgggggtagatataagatgctaaaaaaaaaaaaaaaagataaaagtccaggataagtccaagatatttggtctgagcaactagataaacagtgattgtatttattgagatcagaacatttgaaggatgatcaagttttgggagatggggatctagaatgggttttagacatacttaaagatatctattcaagtggagatgttgagttgaagatacattcatgagtgtgaaatgtagggagtggtctttgctagagatgtaaatttaggagttctcagcatatacatttttgtgtgtgtgtttttgagacagagtcttgcccaggttggagcacaatggcacgatctcagttcactgcaacctccacctcccagtttcaagtgattctcctgcctcagccttctgagtagctgggattataggcacccaccaccaggccaggctaatttttgatcatgcacgtaatatttaaagccaagggactggagaagcaaatggacagggctgctaattaggcttttcttaacatcgccatcccccttccttttccctacttgtactatacctggccacagggataacttatcgcttggacatatttcatgtaccttttcaatgtgttctgctctactcttttgaccttcatatgacaaaaaacaaagggaatgtggtcagcatagagagtaggaattgaacacaggaaaaacaagcagccactttcatgagacgaattctggggtcctgagaaaaatctattactcccaatatgtggtagcttccttagctgctggcagaatcctctgatcattcctgccccaccccgctttttttttgagatggagttttgctcttgtagcccaggctgaagtgcaatggcgtagtcttggctcactgtaacctctgcctcctgggttcaagtgattctcctgcttcagcctcccgagtagctaggattacaggcatgcactaccacacctggctaattttgtgtttttagtagag

SEQ ID NO: 139396 - DNA, 1049 bp, Homo sapiens
agagattttcacctctcttgccctttaagcatcagccttcatagcaacatgcaccaataatgggatgctaaagatgaaagccattgtcatgaaatgcctgtagttggctaatggccactgcttgagagggtctgaatggctcaagcttctgattaacatgataggaaaacgtatcctactcattatagatttcatcaaatagttatccagttaggaagctcagaatgtcagtcacgtatcactgtttttctctgaatagccttaattataacatccagtttcactcctcacaaagcagatcacaagagcaaaggctgtcttacaccaggctcaagcctgtccaaattgtcatgttggaaattccctctttggagactttggcaaatggaaggtttccaaccagttagaaaggaaagaaggaactcctgcaccatgagatatcacaaccttagacaatgatgataactgtagtctgtaaaatgtggtcacatgtgagttgtccagacccagagtcaacatttctgtgctgagtgaaaccagactttctgttgaagggcagcccctgagaaggattccagctgcagttttccttgtagaggtctccaccctctagcatgaaggctatcaggtgttggctctacagttggacaatcacttgtctcaaaattcttcaacttggcaagagatattagtgaccttctgctgaccctacgcctacccttcaaactttagcttagtgcttctgacttggcataatgactaggaatgttgagaaagagacattgaatctacatgaaggtagtgtccacagagaataaactcattgtcacaagggagcttggcccaaggaaaatcatttggtctctcaggagtgagaactagaatatacctgaatttctcctccttaccagatgttgcaggcgtcagttcatactcactaagtttatcttctacttacaacttaggataaatgccagtttaatgcacatacattttcaacagtattataagtttgtcttgctcttcaatgggacccacagaaacctaag

SEQ ID NO: 139397 - DNA, 1077 bp, Homo sapiens
agactctgtctcaaaaaaaaaaaaaaaaaaaaaaaaaaaaacccagtttattccattgttatcatacctgcttcccccagatatacgagcaatgcaaaaatttttattgtctttagtagagatcccagttgtcgaaattggagaaattaatgtattctcttgagcccaaacacctgttcatcctgtatcccctaccacgaataatcagttcttgtcatgattatgataggcctgttgagaaaattgcccatctccttattataatttttatgcatactcaaaatgaatatttaaactgagttttgtcaagagctatgtccagttattaggtatgcacaacggtatgtgagtagggtatatgcaaaattgggttttaatataaaaataaaatgctgagatttttgtctcatcctaataaaataccaagaactccatctacccctccctgcttttctaacactcctagtcacaaatatatgctcaaaaagaagataattatcataaggcatctttattattacagattactcgattgtaaatctttctttggcaaaatgacttgattgattttggaatttgagcctctttgtgatacactgcttagaagtgaccatttcagagaaggcaaagggggacttaggcacactcagaaaagcatgctgaataaatagggggaatcacactgaattgccaaagattattttaatggctcaaaccccttcctgttacgataattacaggaacatctttaagctcttctctgaagaacttgtgaattgaaatagaaaatgttttaatgaatttaaattatttaaaaattggtattagaattttcaggatgaattatttttgtattcccctcttgtttattaagcatgagcagttattaatgcatttttcctcctgtaatacacttattatttgtacaattgtgtatagtgttatgtcacatagaaatatatctctttaggatgattattattttaggaaaatatgcagaaatcacattgtagcagaaacagctacatttcaaaataacatttattctttttcaaattgttttttataaaaagatct

SEQ ID NO: 139398 - DNA, 1039 bp, Homo sapiens
aaataaggaaaggaatgtgagctggtactgataacgcctggtactgtggcgtgcctgggcatctaataaaggcaaaaaggaaataaggagaaaaaagaaaaaagaagggaggagggtactatgaattaaagaataaaagattgatcaggttatttgaagagaaacttcatcatatcccacatcatacatagcatttatcaaaagctgattagacatagtttgtgaaggaatatagttgaggtttagattggagggtggtttccgatcagattttatacgccttgaatactcaggtttacagtctctatcttatagtcatcaagtaccagatataatttttaaagcaggttgaatttatacaaacaggaacagaacatggaagacaatggaggtgaagtctgtcagttaaaagagtttgagtgttgtaacatcttaacgtaaggtgaacatgacctgaattaggtattttgtgggagtgcaaatgtaatgaaccacaaaagacattccaaaatacttgacaagagtaggcaaacggctgaataggagggttaaaaaacagagaattgtacctccccatggtttttaatccaaatgacttggaggataaagtgctgctaatattggtaatgaacacatttctctccagagactgactgactccaaatttgaagccaaatttacttttatggctatgcttaaactgacataatgatatattggtctgctttcttttatgaaatcagctctaaaaataaatattcttgtattcagactttctgtgtgttctgttttcatctttttactgtagctaaagatcactttgtgactttttcttgtttttggccaaaggcttttgcaaaagcaatgaagttatgacctagttctgtggcagaacaagtatggtctacagggaaacctgacttggagcaacagatgtggttttagacatgttgggtttaaggtggtgtcaagatatcctagtgaaaatggcagttacagaactatggctcaaggtcaaagaacactctgaatggtgaat

SEQ ID NO: 139399 - DNA, 1039 bp, Homo sapiens
ctttatttcctgaatttgaatgttggcctgccttgctagattggggaagttctcctggatattatcctgcagagttttttccaacttggttccattctccccgtcactttcaggtacaccaatcagatgtagatttggtctttacacatagtcccatatttcttggaggctttgttcatttctttttattcttttttctctaaacttctctgcacaagacactttgagaatttgaaataggctagcagttgtgaataatgtcattctaaatgttcagtatagtttgtacctaatttaaacctgttagaaactataagtggaataatgtcatcaattttctattattgttattcttatatataagaatataaaaattaatataaaaatttattgcaatatagtgaataattttaaggtgcgtaagtatatatgtttgtgtgtgcatgtgtgtatgtgtgtatggatatataaaaactggcaagatatattgaacaaggtaaaaacaagtgaaagtaaatggtttctctgggtattacagtaggcaggattctaagacggcccctaagatttctggcacctggtatatatgcgccttctcccagttattcagttaaacactaacttgggtgttgttataaagagattttgcagatgtaattaaggtccctaatcagttgaccttaagatagaaagaaaatatgtgtgggccttgcttaatcagatgagactttaaatctggatctagaagtcagagatagaagtcagagactccgtagatggattccacataaaagacatctatatttcaagcttggagatggaggtaaatatataggtggcttctaggagctgatagtggtccctagtcaccagccagcaagaacacagggacttcagtcctgccagcacggaatcctgacaaaacctgagtgaatttcaaagagaatccaaagccacaaataggattacagccccagagcacaccttgattctagccttagtgagaccctgagcataatacccaactaagccatctttg

SEQ ID NO: 139400 - DNA, 1287 bp, Homo sapiens
tcagagcagtttaggcctcgatggcaaggtttccaggagcacagtttccatccactaggatcagtgccttcactctggctaggtctcgtttaaatgccctctccatgggtgggtgtcagctgagtttgttcaggttttcctttttactgtaacaagagcaaattgagttcagtacctcacaattgctgtgccattcctcccacagctcccagagacattctatacaccatgccactattgctggggtaggtaaggggtagtgttagaaattcaagactgttttttctatctcttcagtgccactccatctcaggattttgatagtgaaggataggtagatcttgtatgatatgccaaataattcatgaagggatttagggcagaagtcaagtaggattggaagttttctggtccaagtgcctgagtgaatagtacatagtggtgtccggggttgcagttgtttgggtgagtgttggtgatagtgttggaagttgacatggactcgatgaatccagcttttgagaacgtaagttactgtgcaatgtctatatacgacattctactttgcttcccggtctaatacttgatctactttttccattcattgattcagcaaatatttgagtttcagctatgtgccaggaagtgtaataaatgctagaggtgaagaaataagacaggaaaggtcccacctgtagagaggttataagctagtctattggggaaaatgagcattaaacatcatatgattaattgcagtttccataggagctaaacatacagggatttttgaaaacttttaagaaggcgatctcattcagtccagaaatatgatggacctacctgaagtggtattttgttgttttccaagacactcagttttttttttttttttttttttttgccgcaatcctgaagctcctccttagttacagcagaatctcacatatactgacagcctcaattctcttatctggaaaatggggatgatgacattcctcacataatactaaatgaaattaattcgtgaacaaaacatagcatgatgcttgacaatacagaccctttctcttcctgttctcctagtctggtactcgcagctgtctatttttcagcaacagagatcagcagatgttagcacacctgtggaaactggcatttaagatagtacatccttggaacatatcaaccaatctaaatctgccttactctctcctgtttttgacatttcatcatctccatcatcattatgatgaagagtgctttcagatgacttaatagagaaaa

SEQ ID NO: 139401 - DNA, 1050 bp, Homo sapiens
ttatgtaattataatgattatgggcataagaaggattatggagaagaacggagcaaaataaaagcttcattcactctgctgtcatatttgattatatcttgaggtcaaattgatctttgctattgtcttggctgccggctctggctacagctaatcctgggcaggctttgcagctcctaccacttccaggcccacagctgcaatcccaagcttgctcaccaaaacaagtgtttattcattatatcttcagtagattttattttataaatatgaattgtttatatgcatttctaatatgtcaaatgctttactagctttttaatatctttatatccattttccctggatcattacttactgttcttaactcagtggttcttaactggaagagattttgccacttaggggatacttgccaatatctagaaatattgttggttgtcataattggtggcagcagggaatgctactggtatttaataagcagagacagagatgcttctaagcgtcttattggacaaaggacgacctcacacaagaaagaattatactgcctaaaatgtgatggtgctgacagtgagaaaccctgagtttaacataatttgctcagaactctaaaaatgattcactttccaaaaatttgctgcattttttcttctggtcagaatgtgcacaatggaaattcttcctgaaggatttgtgtgaggagacctattctatagctgttaaatgattggcagggaggttgatagatggaggtgaagtcagccaaaacttaactgatatttaacagccaggaaatacccaacctggaaagtattcattcatagcatcacaaaccactaaagaaaagtgatattttacctctgagaaagttaacagcaaaagtatagtctttctaattagtttttagcttgcaatctaaataaatgacaagtagagaatatcaggtcataaaatatcatttaattttaagaaatattttcataagaatattgacataaaagtgatttaagaaagtgaaagttacatttagcacaagattttgca

SEQ ID NO: 139402 - DNA, 2605 bp, Homo sapiens
gctgatctgacaaagaactgctcaattcatgcaactttctggtggtttcatttgtttttggtaaagaactgtaagcatcaagcggaatagatatggaatctatggcccttaaaatacttttcctaaatactacattttgtcacaggagaaatacttgattatatctctgagttaaaatatgaccttcttaagggagctatgcttattctaagcaaaatatgtactatgtaattatggatccaccacatagccatttaaaatctcataaatgaggcatgtatacccttatctagtcaaattactttcagaaaaaaatctatcacagctgacatttgcctaggacccaaaggaatagtcaacctacttaaaacatgtgtccattaagccaatggctcacagacaaactttttgaaagagttgtcaatttttactgtcttcccttccttgccacccactcacatttttcttaaggcaaattgactcagttcctcacgactccaccaaaactgttcttaataagggcactgatgatcgctgttttgctaaattcagtggatactttttgcttttttcatcttttctttattcattccataaatatttgttgattgtcaactgtgggtcatgcactctcttcatagaaagaaagatatcgaataataaaatttcaacgataagttaaatgatgaaaaagtacagggtactatggaagtatatgacaaaagacatcataggaaatcaactgacctctcagtagtacttcccctctgtgacactacaattcactgtgatttcctccttccttattgactgttctttctgtttccttgctgacaacgccttccctatttgacctttaaatatttgctaaggacatttgtgctttacataaaacagttctggtcattctggcataactatcaactctcaaaattctctccctttaactctcaaaagagtccaggtttggactgtaagtgatatggccatttttctacctgatctcattcagtaccaaagcattaaatagcacatatatatatgctgatgactcccaaaccttttcctccaatgtgccattttttttgagctactgacctatatgttgaactgcctgcttagtaaataacaatttgatctctccctgggaactcgagctcagaatggccaaaactgaacttaatatgctgtcctcactacatatctagttgttgaagccacaaacctggcattcaactttgaatccttcctctctgacatatccttattgtcagtcaaccaccaaaacccgtatactacattctacccataccttaagtcatagtgctcaagtctagccaaccaatgtctctcaccggaattgttacaaccatctcctaactgtgctcccaagttttatgcccacattcccattagttactcttccacatagcagtcaatgtgatctttccaaatctcattagatcaacatcttgttgaaaactctagtgatttctcattgaattcagagtaaacaccaaaccttcaacacatcacatccctgcctttatttctagtctcactttgtagctaattccacctttgctcactacacgccaggcacactgcattctttctgtttgagaaactttgcctactattccaatgcaactattatttccttagagaaagtcacatgtcctctttatgcattcagatgtatttatttccatagtaatcattaccagtaagtagataattgtgtcttaagtaagctaaaaattacttattttggtgtctgttttcttttcctggctatacactcagtgaggacagcaatttttgtctgcttaaatattttttgtctgctagaaatatttttagcacagtgcctgacacattatagacttccaataaatatttcgtaaaacatgaaataatggaagggccatggttagatggggaaaagtgtctttagacacttcctcgtcacctgaaaagaatttcagattgctgatacttcagaatacactctagattgaaagtttgaagataaaagaagtatagggctcaggatgaactcttggagaaaagctcccttccattagaaatacttgttttgcacttcacctaagaatgaaattcctgttgtgttaagtcattgtgacttatttctcttcagcagtttgtgttgtcttaaatatcctttgcttaatgcttcaaggcaaatttgagtttcaatttgactgatgagattatcagtgactacagagctgtaccaattagtttcagatatttgatttatgttcaattgactgtgatgatgagaacggttagaataagagcaatcaaaaatataccttgataaccattaatgatatgtcatgaaacttttgcaagaatatttctacattttataatcttccaggaaaaggatcttattaatttttttcactgagcaggagccctgttaactaagcttttagactcaatcccttagtatcttaataaattgggaccatttatttgtaattgatagaggagggagggtttggacagagaagaatactactataagcaaaaacgaggaagatatttaggttggtaagacattcatacttgtcta

SEQ ID NO: 139403 - DNA, 1726 bp, Homo sapiens
ttcaggcttttcaacctcaaacaattttctccatttacccaattcatttatcattaaatcatttttattcctatatgtgcttcacatttcttataattacctagtactttaaactttttttacaataacaaaaaatattttagtaaaacataagatttacagaagtttccagacaagccatacaaaatggtcacaagcttattttgaaggggggactctacacttgacagcaaagtcacaatgttattagtgagggcagtgatgcttgttaaatgttcccattttggttcaaacaatcaagcttgtccatctacagtgtctaaataaagttagacttggatagagagcatatttctaaagaactggttagctgcttttaaccaatccaattagatcaccaaaaaggcggggaaaggagcccataaaattaaaataaaactacttacccccctcaaaaaaataaaataaagaaaaacacccacacccttgcagctaacctgacaactaccttcattcacagtgctttatacttaaaccaggatgggggaaatgaataaaagcagggagggaccactgcttttaaacgtttcacaacaatccggatgatacgtctagcctctgctcatgctttatgacagtgaatcaggacaagacatagatttgctaatgtacatttaatcaccaaataactgaagatgtctgggtttttttattctgtaatgtttctaagactatgtccattaaatgcaagcaaaaaggaagaagtcttggcagaacaggagaagtgatgcacacttaatgattggatcaatttaaatactattcatggcatatagcctagtccatgctctagctgtttcaatggcttgggcttcgttggtcttccactgctccactacatcatttgctaatggatcatctggattgggagcatttaacaaggcctggatcgatagcagaactgtgcggatctgcagggctggggaccacttatctttcaaaatatctaaacttattctttccaacttgtctacatttggatgataaattttggtcatgaaacgtactttaggggctgccattgggtattcttctgcaagtaatagttcacgtttaaaagtccctccctcaaagggggaatcctttgattccccagcaatgaccacatgaaaataacgggcgttgctttcatctggttctgctttgatgccaggaactggctctgccagcaaacgctgggtttccttgatgatcctgtggggcagctcggccatcagaacctgagttcggcctctggtctcatccagtactttatacttttatttctacttaaaatgtaatatcatttaatcatgtattaaacagctatatacgaaatatatgtgcatgggattttaaaacaatttttaatctcaccatgttaatgaaccatcttgtagtttgaaactaaggtcaagttatttttcggccaggcgcagtggctcaagcctgtaatcccaacactttgggaagccgaggcgggtggatcacgaggtcaggagatcgagaccatcctggctaacatggtgaaaccccgtctctactaaaaatacaaaaaaatagccgggcgtggtggctcacgcctgtaatcccagctactcgggaggctgaggcaggagaatggcgtgaacccgggaggcggagcttgcagtgagccgagatcgcaccactgcactccagcctgggc

SEQ ID NO: 139404 - DNA, 1209 bp, Homo sapiens
atagtatttaaattgatccaatcattaagtgtgcatcacttctcctgttctgccaagacttcttcctttttgcttgcatttaatggacatagtcttagaaacattacagaataaaaaaacccagacatcttcagttatttggtgattaaatgtacattagcaaatctatgtcttgtcctgattcactgtcataaagcatgagcagaggctagacgtatcatccggattgttgtgaaacgtttaaaagcagtggtccctccctgcttttattcatttcccccatcctggtttaagtataaagcactgtgaatgaaggtagttgtcaggttagctgcaagggtgtgggtgtttttctttattttatttttttgaggggggtaagtagttttattttaattttatgggctcctttccccgcctttttggtgatctaattggattggttaaaagcagctaaccagttctttagaaatatgctctctatccaagtctaactttatttagacactgtagatggacaagcttgattgtttgaaccaaaatgggaacatttaacaagcatcactgccctcactaataacattgtgactttgctgtcaagtgtagagtccccccttcaaaataagcttgtgaccattttgtatggcttgtctggaaacttctgtaaatcttatgttttactaaaatattttttgttattgtaaaaaaagtttaaagtactaggtaattataagaaatgtgaagcacatataggaataaaaatgatttaatgataaatgaattgggtaaatggagaaaattgtttgaggttgaaaagcctgaatgtaataaaaatatctgttagaaaaagctaaaagcaatgacaggcagggaaaaaattatatgcaacaaatatagaaggtaaaatatacttactatataaagagctcttattaataagaaagagttcttgtcagtaatacaaattctccaagaatacatgtgttatattgctttacaacatccttatattattattgtcattgtacagataagaaactgagccactttagagctcatgaacataccttagatttctcagaaagttagtggtagtctaggtatccaaatcctcatctgcctgagttaagagctcctctctattgtactataagtcaacatttgttaatttattaatattataactgagcctgattcttcctgtacttc

SEQ ID NO: 139405 - DNA, 1025 bp, Homo sapiens
tcttaaaacccagttccaacataagtctgtcggccacaaactcaatgtattacttcattaaagtgcagttcatcctaatgagcttcactggcaagtcctcagtgaggaactcatgttctatcctagcagctttgataattacttactttactatctgctttgatggtctgtcatgatatttggaaaatgtaaaagaaagtagaggtttctttctggatggcccaggaggtggacctgtccaaggacatttggcactgggaagccctgaagcctgagtaaagatattttatatcccatattctggctttctttgcagcatgtgatgggataatagatgaaaacttggtggaacaatttgttcaagaagttcagattacagaaaccttctgcttctatggcttccaaattgctatagaaaacatacattctgaaataaataatctccttattgacacatattaaagataacaaagaaagggaatttctcttcagtgccattgaaacgatgcctgtgtcaagaagaaggcaggttgggtcttgtgttggattgggaacaaagacgttacccatggagaacgtgttgcatgcagcctttgccctggtggaaagcaccttcttttctggttcttttgcattgatattctggctcaagaaacaaggactgatgcctggcctcacattttccaatgaacttattagcagtgatgagggtttacactgttactttgcttgcctgagtgggtgtgttttaaagttagtcagtaatgccttcttgagtagaaaatatttgggcaatgacttaaagaatgtgagagagtcaacaatttgaataatatctaagggaggaagagtgtttttaacagagggaacagcaagtggtgtctccagacaaaggtttgactggtcatttcaataaatagcaagaaggccattgtgtcttatgctgagtggggatgaagtgggaagctgtaagggatatggacagtgaaaaatttatggcaaaattctaagggccttaaaagcta

SEQ ID NO: 139406 - DNA, 1190 bp, Homo sapiens
cgaggaagtgaattattggggtcaaccacattttttttccttcctacagtctgattgccctttttagtttttaggatctttgtggctgcatcatttttccccttttgaactgtgcattttctaaccccatacttaaatattctcataacctccaaattattaattagatgcaacattcagtggtatattactggagtttctgatttctgcccactataggaatgtgcttcctgagaagattgggatcgtgattataataatagttaacaggggatgagtactttctaggtgccaggcactgttctctctgatactttatttgatgtattgttgttattcccattctttaaatgatgcacagagaggttaggtaagtgacttactaccaagtgtcagggccattaagggtcaggattctgaattcctgaaatgatgaaatttagcttgaagaaattggtttgatttcctgcttagttttcaatttcatggtggtctttgattgtattttgtgctataacactgccttagcatcctataactatagttacagtgttatattaccattttttattgttaatacaaagccatcatgaaataattcagtttatgtgccagctttttttgttactaattcttgaaccttggcgctgtacttcttcatgtggatgcctgttaaggaaagataaagttagaaatctttgaccctgctaggaaatttgtctttgttatattgggagctcataaaactgaagtattcaaaagttagaatacatacacacaagaaaaattagtaactaatttaataatgttttctttgcacatgtctctgttgtcttttggtcagagtgaagctaaatgtgtttttcacataatttgtagcctatatgaagtcctggacatgtggtatggttggaaggactgttgatgaggtttattgtctctctttattcttttatgttgttagtgtccccatacaacggggcggggggagtggggacaaaatgataacttgctttatatatgaagccttgggtttgaatcatactgttatcacatttcctatgtccctatcctgtctcctgcaggttttctttcttggttttcttttttggttttctttcttcctttcttcctttcttttcctttctttcctttcttccttttttctttccttttcttttttcctttct

SEQ ID NO: 139407 - DNA, 1616 bp, Homo sapiens
atatgattattgtaattacctctttggcccagttgctagtaaattagggaccccttaatgatttatttcctgtttattcaccctgatgaagaacttgtatctcttttaaactgtactttatcgcctttctcaaattccaagattctcatcacattttttttcttcccaaactctaaataaccttttaatattaagtatctttgtggaaacattgttttctttttctatcccaatttttaaagcttttttaaaaaaaagagtgcttttgttgggatgtacattttccaaatgcaaaaacatttatgattctgtgtctcttataaaatatgacactctctacttttctctcatttatttagtgccacctatgtgtgtaatttcattacccacagcagtcttaggaggctggtcgagttccttatttgcagatgaggaatctgaggtccagagatcacttcttggtgagagtctcacagctattaagtattagagccaagattttgaacgtaggtctgattcacagcaaaaccgttaaccactaagtacactgactccagtaagagccctagtcctcacccaatacactttaattcccctgtgcattcattcaaattcattgaatttgctgcctttggaaacctctcaggaacctcctcaacctctcttctctacagacatcagctttgcctgataggtagggatcatagcaaaacacagttttccaaggtggtgataggtggagtgatagtgctctggagatggccaaagaaggaaggtatgagtgtatctgtgggtgggtgagtggtggataaggggaaggacagagccaaaagcgacggctattggaaaaactatgatgagaaacaggaagatggaaccttgttggaattagtgaaagaccttagaattcacaggaggtatttgtccttcacgcgagtgtagaccaaacgtaacctatgagtttcttttattccacttattaaagcagcaaccaaaggtattatataccttctgtattcacttaaaatgactgattttgaaaaagtcatgcaaacatccatttacagataagcctcattaactcaaaggcagtggccctgttgggctctgatgattactcaaaccatttctgacactctgacactacatccggaaatcatccggaaatgcattcagagcctgcaaaagctttttttttttttttttttttttttgaatagctacagcacttgcagatcttcctcctttgagagaatatttgattttaggaaataagcaaatgtagataagtatgattcaactgggcaataacttttaggcaaagagaaaaaaacaaaatatagcaatgtagtaataaggctgatattatagtgcttttatgatgagtctgaaaacagtctccaacatttgtaaatgttttaaatcgggtctgtctactacagtagcccttaagccatatgtagctattgagcacttgacatgttgcaagagtgaattggagactgattttaattttatttaattttaatgtaagtagtcgcacatgacccgtggctactatggtagatggcatagttttagacaagggcagtagtcttgggtagatacttgattta

SEQ ID NO: 139408 - DNA, 1064 bp, Homo sapiens
ttttcagggtagctgttggtaagattgtaaagtacatataaactccttagtcaaagtgtagatgtggctatgatcttaggattttactaaactctgatggatggttaacagttatcatttttttggctcttatataccaagaaaattaataatatatcaaaagcaggctgcaaatctatagagacagaaagtagattagtgattgcttgtgctggggctggtggggagaacatagctaaagagtacaggatttttgtgtgtgtggcaatgaaaatgttgtaaaattgactggtaattattgcacataactgtaaaccttctataaaccattgaattgtacatttaaattgatgaattataatgatatgtggattatgtctgctaaaatgtagtatgtgacccaggcatactgagcaataaatacacacatcttgcttctaaagtttaaaaccaggcctgtgtttcagtgtctagaaaatatatttcataattgaacttagcagattcttttggctagcaacaggacaaagtagtatccttagatgcctgaaacacgtgtagggggacagagataaaaggattaaaagcatctaaccctatttctggctctggactaataatcgcagaccaaaatacaagtttgaatagtagaatacctttccctgaatacataaagccaaaagttttagtatttgtctcttcgctgtttcatatatccatggctatgcaatagacaacagcatcacaccaacagaggaatctttgataacttggagggtatttttttcttacaattatacactttatctacttacttacatcactaggtaaatgctgtttcccataaagggagagttgtctttatttgctactcttttagtttttcctgtagtctataatctaaagtgttaagcaaacactcatttcctctatgcatttaagaatttgtctagtttatacattgatttattagatcacttctttttaattttcaatcagatttctaccataaacttaaaattatttcatctttggaccttccaattatttatctcctgtaccat

SEQ ID NO: 139409 - DNA, 2109 bp, Homo sapiens
ataatttgttgtaaagatcaggtcttaccttgttgcccaggctgctcttgaagtcctggcctgaagcagtgctcccacctcagcctcccaaagctctgggattataggcttgagccaccgcatcctaatattttatatttttatggatataaaaaataatttggtatctttcagagttgtttaatatcattttaaatttaaaaacataggcaacttaaactcctataggctgtctccatcgggtttctgtggtttaggagaccccaccatcccagtgcatgctgataacgtcatactgatcagcatccagctacccacagcaagaattgaccacctcgtgggatctaaaatttaaagggggaaaagtgagttgtgaattgctaatgtgctgatagccccattttgcttgggaattagagggcagtttttgtggtccttggaatgtggttaaaattcttctgcaagtggaagcatatttatattactaacaattactggtactaatattcaaatattgaaggaaatttctgttgtggacttatgtttaaagctcttagaagttgaaattattggaaagaagacttgttttgaaaatcataatgttgctgtattgtgtttagagaaatattccaaacgggagtaggctgctgtgctgcatgcagactttgctgaaatgttactatattgccgttatgtcccactcagcaaaaactgatgattttaaagcttttgcttcttgaaactagaaaaagaggggtcagccttaaccaaaagttgatggcagagtggtcattatttcagttaaacatgaaaagcatgttaaataattgtatgtttgcttatttacagctggcagcctgataggcagattccatttcatgatgtcagattcccacctcctgtaggttataataaagatataaatgaaagtgatgaagttgaggtgagttttccctgccataaagtcatttagcactgaaagagtggggttaatttatctgtgtttttttttaatactttgtctttaacactgtttaaattactttgagaattacagctggaatggacacgtgcttttgactaactcatcttattaataattcaaaatgatacatgatgcttacatttggctatttgagcagtactcagagcatgtatttgaaagtcactgccgcaagttcctttgcccactagtaattcttttctccttctctcaatttctgaatctttgaatagtatgttgtttgtttacaactgtgtccccattgtaagcaaaatggattatgaaaattaattttacacaggaaagaaatcatgctttattacaaaatagtatactagaatttctttaagtagcagtgaatcttcttggtatatttttaaaaacctacaagctttagtttatacatattggtaaaatctctttttcacaggttataccgtgaactacctgcttatctcccgttgagctctttgaccaaaatgtgctatggagatctaacatgtgaacagaaatgttgtgtttgtgatttctttctccattagaaattggttttgtatttaaggcgcttacagtgcctcatatagtttgtgtggtatcttctctcctttgtatcctttcacatactccattttgagctgcttctcttctttttctacaataataagcataatgccttactattagttaataatagttgccgttccatgaatatttgtagtatgaaggatgtcgctaagtagacatttgtgcaggtgaggcagagtggttctaggtcctgtccttcagttctttatttatttatttatttattttttgagatggagtctcactcttgtcatccaggagtgcaatggcgcgatcttggctccctgcaacctccgcctcccgggttctagcgattcttctgcctcagcctcctgagtagctgggattacagtcgcccaccaccacgcccagataatttttatatttttagtagagacggggtttcaccatgttggtcaggctagtctcgaactcctgacctcaggtgatccactcgcctcggcctcccaaagtgctgggattacagatgtgagccaccatgcccagctggtccttgaatt

SEQ ID NO: 139410 - DNA, 1061 bp, Homo sapiens
tggttgaggatatatgacatgtggtttttaaagacacctaggggcattttaagaaaatttcctcgatatctgaaaatctgtagatttcaaaattatgttaatcatgaaatattctgtgttgtaatttttgtgtaggtgtattccagagcaaatgaaaaagagccttgctgttggtggttagctaaagtgaggatgataaagggtgaggtaggaaaatgcctatttaaatttttttcttatattgtttcctttttttaaacccaggttgtacattcccgtgtggatttctattttgaagtaatatctaattttgagtaatttaattaaaatgttttcactatgtgttcagtatgtttctgttggtcataaattttttcacatagattatttattttaaaataactgaatagggagaacttcttattcttactttaaaaattgtgattagaagtgacttttatttatttctcagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtaagttgatacacaagaaatgctgagaacttggaagtgatatgcaattagtttagaagaatttctagtagtttaaaattttttaaactactagaaattgattttaaatttggtggactttggcaaaaatggtttggtttgcaagagcaatggagaaaaaacttatttaacttttcctacttatagaatcaaggcagccttgcgcttgtttaaacttacttggctatacacgtgtctgatgtacataatgtacatttgttttctaaactaactttgttcattctaagatttaaaaactgatcaaacaaatgtgataattctgtcataagtcacaaactataaacgatttctccgtttttttctcttttacctaaaatgttttcagataaatgtgtaataagtagagccaaagaagctttaaaaagtcatctcatcttaca

SEQ ID NO: 139411 - DNA, 4152 bp, Homo sapiens
cttaccccattctccgtgatgtgcttatttcatattgcatgcctgtatcaaaacatctcatatgccccataaatatatatacctactatgtacccacaaaactaaaaattaaaaaaaaaggaaaaaaaaaggcctgcaacaagagaagaagaaagaaatcagataccctgtaggtagctatctcccaaaagttttcaatagttgacttaagaaaactactgacttgtatgtaactgaaatcaggaaacctgtagtgtagagtggttcccctgaatatgtctcttttggtaatctaagctgtatttcagaaatgtacagaaaaggagctaagcttctaaatggatatagcatattttgcataaatcaaatttaatatgaatccatgattcttgtatgtgtaaatctgcctgcatttatttatgtcagtagttggtaattattcatcttaatttttttttttaaatttctaggtgtgccaaagaggcggcacataaggattttaaaaaggcagttggtgccttttctgtaacttatgatccagaaaattatcagcttgtcattttggtgagcatttttgagttgtttatttttagtttaattcatctggggcaattgccttgataataatgttgttaatttaaatcatttagtccatcaatgaagtcacctcaaagcgagcacatatgctgattgacatgcactttcggagtctgcgcactaagttgtctctgataatgagaaatgaagaagctagtaagcagctggaggtatgtcactttccctagcactgcttgtaagggtacctaggaacgattaactgtatcattccacaacttgaatatggggagcttgtcatttatttactgcttcttaacaattccttaggttctatagttggaaaattgtacaaagcataatcatactaaagtttccatgcctgaggtttcaaaattaaacagcagcttatgtatattaagggacttctggtactttcacttttactagaagtttatcaaagttgctaataaaatgcggcaatgcttcttccatataacatgttgtcattaaaaatactagagaatatttaaatatctaatcatattcctctcattatgtatgtttatctttgtttaaaagggtatagaacttcttcattctaattggttgtcattctttaaaactcctgtcttcagattcccgccagaggctatttccctaacttactattttgtctcttaaggtgcattttatctacttttattaatcctccaataattttcatcaccatatatttgttttcattgataactatcaagtacgtccatccattactatagaaactaagtggatcttagatgaatgtgccagctctactatattcctgtcaaattccagagttcgtcatcattattcattagaaggaaaacaccacacatttgaaatagtaaagaaaaaaaggagttccaaactgcattttaggagaaaaggtagtcaagactgtgttcttataaaaaccctgtgaaatttgccacctgtcaacttgatgtatgatgctgaactcttagcagaaggggaaaagtttaatctccttttgccactttgttttttcttaaggccatggaggtctgtttaattggtctttgctctcattctttcttgatgtccctgtgttcatgattttgtggttccttcagtgattctctcataacttttagcccagagctgcctccttactttgattgtgagtattatgaaaatatactcatatgcctcttaaacatcgaattattcttaaatgatctatcatacttttggctaaccatttatcagtgaattatcaatgaaaaagaacgaaccagattaatgaaccaggactcaaaaaacatgacttcttgaaaagtcctagaattattttatagattttattactctagtctaaaaaaaatgggtattgcacttttaaattatttatgctagttgtattcattcattcaaattatcaggtctgttgaacaatgagaaactagtatgcatgcctatctttcttcactactaatattaaagagatttacatgttcctataagaaattcccatttttcaacatgagccactaatacgtttggttttcattaatggcatgctagaactgaacactaaattttgataatggtatttaaagacagtggttatccacaagtttgggatgtcagtgtaacttagtttcgtcatcactggatatttacaagtgctcatcataattgtggatccagatcacaaggtcttacggactctggtctcatgttagctttcagatgcttactaagtttttaatttttgacattttttgattattcagtttaactactgtaccaacaatttttgattccttaggttttgagggaggtgtcattttaatgtcatttcaacagaggaatgtttagaccacagtacctaatgatgttataaaaaatggcactgtttccagaaaatatatactgataccttttaataaaaatgaagcgaataaaattttctataaagatgatatttaaacatttttttacctaaataagtaacattgagtttgtcagaccgagtgagctggtttttactggggaacatttgacctgcttcttagttattatattgctgatgtcattggttaactaaggcagccttgtgataagttttcagcagttaccttggaaaatgtcaacaagttctttcctattaacaaaaacatataaaatgtcatagacctttagtaacctaaaaagtacttaggctgtgagaggtattttctaaaacctgttagttttaacctaaaactattaataatttatggacccctcatatacagggtcaagataatttacatggctggcctaaatacagttgtcgtaatagttgataaagtgtattcatcagacgtccatttctcttcagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggtaaatattttactgcatagtttttttttccccaaacaagtatttcagctggctaatcttttgtcttaaaatgtttccccttttattaggatcaggatgcagtgaaaaaagctagaagctttctcgaatttgctgaagatgtaatacaagttccaaggaacttagtaggtaagtcagaagtatctgttgacatatagtacaacaactaagtttaggtaaacagtttatttatagtgatagaattccattttttcttactggagggtatcatttaattgaaacatagtctttgaaatatgatctgttctttttttttattatttaagttttagggtacatgtgcacaatgtgcaggttagttacatatgtatacacgtgacatgctggtgcgctgcacccactaacttgtcatctagcattaggtatatctcccaacgctatccctcccccctccccccaccccacaacagtccccagagtgtgatgttccccttcctgtgtccatgtgttctcattgttcaatcgatctgttcttacagcatacaaaaaaatatttgttaagtatgatgctcaaaggttacattttcagaaggtattcaaaagagattgcttttctagttcaaacctactaatacctgaaaggataaatcttgcccagccctcctgactgtataccttttatatcttaaaattaaataatttttcaaaatgaatgatatttggggactttatgatttgaaatagatttgtatttgatctttcttatgggactataaaatgatagcattcattttaattatctcagggttgaagatctgaacataggttacttaaatctaaaaagtcccaaagctagaagaaacttcagatgtctctgggactttctgcaaagtcaatagtaattctccattttgacttgagtagtgttttatcaccatcaccatcgtgagtatcagcaaatatttaggagctcttcaccaatactcctaaatgctgcagatatctttagtagaacatatcaaaaccaggtgcag

SEQ ID NO: 139412 - DNA, 1037 bp, Homo sapiens
aagcaaatttttgcttccatcttttcccccaactttgccttgagctttgcctttaaaggcgaaaaggaaaaaatggaagatgagatggtgagggcaagcacatggtggatgtggccaatgtaagggtacttaggtaccttgggtgagccctcagaatcagatgtagttcacatgtacatttccagaattagtaattcttaagtttgtaatgtcttgctttaccactcgtgtcatgatgcaaatgaaagcagtcattttccagtaatgtatatgattgtaaaataaataaggaaatgatcaagtacctattttttactggtacttgaaatcccaagttttaatagatgttactgaaaaatacttaaattggtttaaagctttttcattgtggttttgagttatcttaaagtgggttttcttaatcttttactctgtgactaatcccttcactttttaatacattgctaaagtttgtaagtaatgcacaggagtgatactctgttaacacattgaccttgaagaatttgtattccttttggatgtatgtatagctgcttaagccactttcagacttagattatcttttataaatgtgccttccatacagaattctgaaaatatttaccatggacaaagaagcagatttaaatcaggtacagacaagaattgaaagtgttgaataagtgaatatatttcccattctctctacttttttcttaattcttatagaactttgcagaaagaatgatacataccacagtaccagcaagtttaaagcgtacccttttgtgcaaaaataagaggttatctttgaactgccttaaaaatccaaaattaccctatcagtttgcaagtattaatcaactctggtacctgaccaaaggagtttaaacaatgatgtcctaattaaacagaaaaccagattaaccatcttgttgaaaagagtctctactttggttttgaaatcttacaattcaatacatacacatacacataaaaatatctatctatatgaatgtaatagtttacagtagggc

SEQ ID NO: 139413 - DNA, 1317 bp, Homo sapiens
atctgtttagaaatgggtttaaaagtcctgcagtgaaagtcctgcgttcaggcttctgtgtatcgtttgttatagttaatgacatcccttgcattccttatactgctttaggtgttagtggcttcatcagttgtagcaggggaatcccagaaacctgaactcaaggcttggcaggtaggaaaacattccttgagaaatacactttcagtttatattttaatgtttattccccttgttaacaaagattacaaatgatcctcaggattagggactggagggaggagtgtttgtgggtatgtggatccattgccctggagttaaagcttaaacaccttcatgccgcttgtaaggcttttcctaattacttgtctagttatcatctttaaattatcttctcccttgcactctagagaaccttaagccatactgaagtactttgagttctctgaacattctcgtgcttattttgcttctagacatatgtacaggtttactctgcctggaatgctttttctcctccacatgtcacctcattttgaccttattccttacaaagctttccttgtgtacttgccgaagatccccacccccttgactggttcaagagccttccccttctgttttgcaatgtgctcacccctagcatagcacttaaacatagatgtttatttgttgatctcctcaaccacattgtaagttctttgagggcagggagagctggtgagaactgtttatggaaaaaaatgttgtggactcatggattaaaagcaaaggtgccattttacaaagaggactataacggcaagtggattggatatgtctcattgccgggcagcccattattccagaacacagagtaacttttttctggggtccgtactaaaggccatcattccattcttgcctttcttcattttaatttactattcaggtctactcgtgaagtgcttaaattagagtggcccttggggtactccagcagtttagacatgttgcaagaaaagatattcgtaaataatttgctccgaagtcaatctaactaaatctgttacataggattttaaagctattttggtgatatttgacccagagggaagggtgtagcattcattccatcacatggtattttgggaaataatacagttaaaggcttttgtaacaaataaagcttgttggagaaaaacccaacatgcagaaatgaattgccagttattaatttgcacaattgtttctaggtttccctataacttgtgacaagaagtagttgttttttttttccctcttaatatatatatatatgggctaggagtacagaca

SEQ ID NO: 139414 - DNA, 4297 bp, Homo sapiens
gttaggattgcattgtatcaaatcccttgttcttttgactaatgttctttcttagatcctttgatttattctcaagaatatcttctttggttatcagcagctgccctgttgccattctttccatcaccagaacttccctcgtttgggcctggcatctctcaccaaaaggtgactgctttgccccagtgggataacctggactactcttctgttttgcaagatattcctattccatgagctattactatacctttggaggaagtcactcactcagctgcagtctctcctttgctcaaattctatgtaaaacagattctggtgtaactatgtaaattgctaatgatggcagagcacagatgaaacggaccaaatccttacctgacctttcttttccagaagctgccacaaccaagattttagaaacttagctttacaggagcttctccaatgactgttcatgtagacagtctctatgataacctctgcttcactgagacgcctactactactatagttatgaatctgattccccgtagccagtaaatgagatgtttatgagtggattggaaggacagtggttagaaatgaggtttcatctggttttaacagaacccaacatactggaagtgctttttgtaagggtctgtcattggaccccaggtgtatatttctatcaactaaatgtatactgtttctcgtacttgttgtagcagagttgtagtctttaggaagttttcaaggcatgatgtaagacctagctgtctggtcagctattaaatagttttgttttcccctcatgaggaatagtcagcattttcagttgatgaaaaaatcattgttccttaaccatagtatatgttcttttaaaacaaaagatggcccaaactcaatgctttgtaaattaagatattaactggcaaatctattttaatcaagattatttacaatgtgtgattttttaaggttagctggttataccttgaatgtcatttatctatattcatacattttagcatgttttatttaatatcctatcatgaagaagtccccaaaatagcatatctgtgccttagcagtagaataattggataatagtgccaaattagacaactttaaattttattcagtataattttactgctgagtgtttttgttatatctctaattcttgacatcaataatctgttatctgtagtaattttctttttaaggagatcattcaatttcctgataattctgtgtaacagtgtttactgtaaatttagaactgaaattgaaatattccagtatatttttatctgatgaaaaggagaaaggttttattaagtaaaatgtcaaattatttttactgttatcttgtatattttaaataggaagtagaccagttgcgtttggagagattacaaattgatgagcagttgcgacagattggagctagttctagaccaccaccaaatcgtacagataaggaaaaaagctatgtgactgatgatggtcaaggaatgggtcgaggtagtagaccttacagaaatagggggcacggcagacgcggtcctggatatacttcaggtacaaactaagcattttactcagtaactttatctgttcctagacttatagctgctaatctctaatattcattagaaccccattataacaatttgccgctacatggtttccaattcacagtgggttaaattgtgttacaggagacatagagtaaaaacctgatgataaacacgtagagttcacagggccggtgcaagttctgttcatgctctgattgggggtaaatctgcaaagcccttgtgtgttgatgattttcttaaggcctctcctgattttataactgtatagtcaaaacttttttcatttgtgtactgtggctcatttttattttgtcaggtatgtgctggtcatacttgctggatggactgtgtaaatcaggggtctgcctcttgtggctcataaggtgattttgagtgacatggccaaagtcagccctaggcacagtcaagaagtaggcgaagtttctctttgccttcccagcttttctgtccgtgcttctttcttctctcccagtacctttcagtgaacctgatccccacctgccagtgcctactgtctttcttgctcaacagtgtatctcctttgtaacttgctaatgatggtataaggtataatccatttcacgcatatttgcatttcaaaaaggaactctttaagatggaaaagccttcaagatccacaggaatgaagctataatggtgaagctataattggtcattagctccaacagaggaagagagaggtagtagagctgatattctggagttggggagagttacctactcctaaggccaaccttgaacctaacccctaacccctctcccaacagtctgttctttttactcatgaatttctgcctcaccgtggagctctttttctccgctcctgtcctctaagtcgttaaccccttcaggcataatgaatttattatagtaattctttattaatgatcaattattgtaatgggagtgggagggcaggttgtggaccaaacatcaggcaagcatgtatctgccttcagctagatccaatccatgacccacaagagacccttccctgaagcagttgccatggtggcctcctttgccaccctctcagaaatgaccaaaatatatacattcccctctgtcctgggccaaatcttgctaaaaggagctctctttttagaggttttgtttatcagggtatcacacttaactgtcgtggataatcttttcctccagagagtatagatgtttaaaggaacacagctatttaatgatatggcacatcaaggtttgaacttaggtggctaataacatacctttttaaaaatgagaatgaaacatgtttataaccaaaattaacctcaaatattgcaaagcccttcattttgagtttaaaattttgttttatgaaatggaaagtgataatactcttggtgggcttataaattgggaagagttttggattacccctgaaacgtctctggaagcttctgttaaccctcttttttttttttttaaagtcagacaatggtatataacttttaactctcgataggaactaattctgaagcatcaaatgcttctgaaacagaatctgaccacagagacgaactcagtgattggtcattagctccaacagaggaagagagggagagcttcctgcgcagaggagacggacggcggcgtggagggggaggaagaggacaaggaggaagaggacgtggaggaggcttcaaaggtatggagatcttcattaagaaatcaaagtgaattgtaacagctgtcttgaagttccatgagaaatcctattgatgcaatgaactgttaccaagatcccatctctcccgttttgtgctgataccataggaaaggatcagccttccacttgtgtagaaagaaagaatattaggcagccttccttatggttcatacagatatatgaataaatgctgataactaattcagcatcttggtgggtctaaacagcatcccttcattaactcacattgacctgtagatgcagaattataataactgtgaaatattttctgttacttagcagcaggctagattattagccattgtgtaactggaatcactggggtattgattacatttcagattctgtggttggtttaaatagagggtgtgggaataaagaacttccagtaagcatttcagaatcagtaactgttgaaccttttgaaaatattctcataggaaacgacgatcactcccgaacagataatcgtccacgtaatccaagagaggctaaaggaagaacaacagatggatcccttcaggtaaaacctgtctgcctcttttcatcttaattgtttgaatatggtagtttgagatttatgagtttattttactttattaaaaacatgttcaaagattacaaatccagtttatgtgaaatattttaccttcaacattacaattgtagtcaatcttagttctttgtgacaagtatacaaataagaggatttctctagagaatatgcagtctgagtatttgtgaagaccttgacagccacactatgattttattatttattatttatttttatttttttgagacgggagtttcgcttttgttgcccaggctggagtgcaatggcgcaatctcggctcagagcaacctctgcctcccgggttcaagtgattctcctgcctcagcctcctgagtagctggaattacaggcatccactaccatgcccagctaatttttgtattt

SEQ ID NO: 139415 - DNA, 2609 bp, Homo sapiens
aagacatgataggattgtgagtttttctctaactttggatgcagtgagatgaccagtgtgttccagttaaagaagaagagtgttttaaaatcataaaccaaataaagaatcctaccttacattaatttcttgcacttcttctgttctcatctccatttctctttttaacatgtggaatttacacttcaggtttaaatttcttgtcaggccaattacagattacagtaggatatggtctgtgtatataacaactataacttgttttagatcagagttgactgcaataatgaaaggagtgtccacactaaaacattacagaatacctccagtgaaggtagtcggctgcgcacgggtaaagatcgtaaccagaagaaagagaagccagacagcgtggatggtcagcaaccactcgtgaatggagtaccctaaactgcataattctgaagttatatttcctataccatttccgtaattcttattccatattagaaaactttgttaggccaaagacaaatagtaggcaagatggcacagggcatgaaatgaacacaaattatgctaagaattttttattttttggtattggccataagcaacaattttcagatttgcacaaaaagataccttaaaatttgaaacattgcttttaaaactacttagcacttcagggcagattttagttttattttctaaagtactgagcagtgatattctttgttaatttggaccattttcctgcattgggtgatcattcaccagtacattctcagtttttcttaatatatagcatttatggtaatcatattagacttctgttttcaatctcgtatagaagtcttcatgaaatgctatgtcatttcatgtcctgtgtcagtttatgttttggtccacttttccagtattttagtggaccctgaaatgtgtgtgatgtgacatttgtcattttcattagcaaaaaaagttgtatgatctgtgccttttttatatcttggcaggtaggaatattatatttggatgcagagttcagggaagataagttggaaacactaaatgttaaagatgtagcaaaccctgtcaaacattagtactttatagaagaatgcatgctttccatatttttttccttacataaacatcaggttaggcagtataaagaataggacttgtttttgtttttgttttgttgcactgaagtttgataaatagtgttattgagagagatgtgtaatttttctgtatagacaggagaagaaagaactatcttcatctgagagaggctaaaatgttttcagctaggaacaaatcttcctggtcgaaagttagtaggatatgcctgctctttggcctgatgaccaattttaacttagagctttttttttttaattttgtctgccccaagttttgtgaaatttttcatattttaatttcaagcttattttggagagataggaaggtcatttccatgtatgcataataatcctgcaaagtacaggtactttgtctaagaaacattggaagcaggttaaatgttttgtaaactttgaaatatatggtctaatgtttaagcagaattggaaaagactaagatcggttaacaaataacaacttttttttctttttttcttttgttttttgaagtgttggggtttggttttgttttttgagtcttttttttttaagtgaaatttattgaggaaaaatatgtgaaggaccttcactctaagatgttatatttttcttaaaaagtaactcctagtaggggtaccactgaatctgtacagagccgtaaaaactgaagttctgcctctgatgtattttgtgagtttgtttctttgaattttcattttacagttacttttccttgcatacaaacaagcatataaaatggcaacaaactgcacatgatttcacaaatattaaaaagtcttttaaaaagtattgccaaacattaatgttgatttctagttatttattctgggaatgtatagtatttgaaaacagaaattggtaccttgcacacatcatctgtaagctgtttggttttaaaatactgtagataattaaccaaggtagaatgaccttgtaatgtaactgctcttgggcaatattctctgtacatattagcgacaacagattggattttatgttgacatttgtttggttatagtgcaatatattttgtatgcaagcagtttcaataaagtttgatcttcctctgctaaattgatgttgatgcaatccttacaaatgattgcttttaaaattttaagctaggaaaagaaatctatagaaagtgttctgttacaaaatgtaactgttaccattggaaatttcacgtcataggaagttagcctttatctaccaactttcaagaacttgtttaataaagcgaaaaactcaaccaaatggtacaaaaccacagtgtaccattaaaatatgcactaagtctcttttttacaaaggctgtattcagcaaggcgctaacttgcttaaatgtgaattactaacttctaaaactgtactttgattcacatgttttcaaatggagttggagttcattcatattacaatatttgtgtgctaaacgtgtatgtttttcagttcaaagt

SEQ ID NO: 139416 - DNA, 2465 bp, Homo sapiens
aaagttgcaaattaaaacaaaagatattttgttttattttggccatcaaattggcaaataataaaaaatggagaggtgtcagaaaactggcacttgcctgtactactggtagaagtgtattttagggttgccctgctggagggtaatttggacatactcaagagccaccatgccttaagaatttatcttaagtaatttttcatgaatatttgcaaatatataaatataaagcttcagtgataatcattgcaagctaacgataatgtaatgataatcattgcagtgttctttataacatcaataaattgtaaacagcctaaatgttttcctatggagaaattgctaactgagttataatagagccatataatggaattctgtgacattattaaagatagttttgggaaatatttaatgctatggacaaatctgtgttatcctcttctctcatgtaggagggaattgtgtaaataagactaaaaaccagttctttaaaatagtgagaaagaaggataaggaaggttttactgtatgtaaggccttgatttttgtcaatatatatgtaagccaacatattttccaagactttctgtgatgggatctgatttagttggaatacatactgttttcagctcatcagttgattaggcctcttaatgccatttgtcagaggcaagtttactattgtaaatcagcttacaacaatggcatgtgtcagcctatagcttaagcatttgtaaatttaacactttttcagtttcacaacaaaattgcattctgattattaatgatgcttaagctgttatgagatgaaagtatatctgttagctatttgacattctataattaatttaagcaaaggtaattaccattcaagggtcattgaaagtgataaatgctttatatgttgggattaataattttacttcttcttaagggtcctcatattttgtgcttgcaaatggacatatcctgcccaacagtgaaaatgctcatggccaatctctggaagaagattccgcattggaagctttgctgaattttttctttccaacaagtaagttcttgtttgatttttttccccctctaatgttcttgttttgaaaacagtaattaaatgtttaggaagcagtgtggtgtaatggcactggagtgggacagagctgagtttgaatcctggctctgctctttggcttaggcaagacaatctctctgaacctcagtgccctcatctttgaaatgaagatatttaccacaaagaattatgaggatgaactgagataatattcataaggcatttcataaatgtttgttactgtttataaaatacttttccttcgcaaatatctaatctttcacaatttgcctgaatggcattgcctgaaattcagtcactgacccagtattgtgaaattgatgtcttctgtggcattagtgagggtactgtgtgactgatgttatggaatatgccagatgttttcccatctgttttaatgatagaaatcccaggtttcaagtctcactgtctttttgtgattctgtatataatgtgtttatcaagcacattatgacccctgagaattattaaccacaaataaacacgtttcattttgtatagcatgtggtgccctttcaaggagaagcttcatataaattggaatatgtgaagtacaaagataaagctcttatgaaaaatcatgcagaatttattctaacaaaatttgatatactctataagcacaaaattatatctgttctttgattccaggcctttccactgaattctttagtgaacttgaaaaaatctctttatgtttctttatacttgttacattaagtttaaaacaggcatctaccaatgagaatagcaaaataaacaagttccttaaataaactcaaaatactgccatggtcaaattgagtaaataaaaaagaaatctgagacggtgttatgtcgtataggctgaaagaatggtttgagtgccacagttagtcgtaaacaacaactaatgatgatttaagctttaaagcttatgaaaacaacagatgtaaacagtcacatacttacctgtaataactacattgtacagacactgaagccacctgtaaaaatggttcgaaaaagatatctgcatttcccaaatatttctccaacctggtgcaggaaagtaagtcaaaatcaattatatgaagtaaaaattttgtccaacaaaataaaattgttccattttaatagaaacatctgacctaggttgattcaaaaagtgattaaatatttatcaaatgtacatactgtctttgaagacaataactacagcttcataaaacgtgaaatatttttaaccaatttatttcttcccccacataattgaaaataaacactcttaccacttaagcatgaaaaaaaagttcgttgttttgccattaggctactatttgtaaaatatttatctcttgcagattaa

SEQ ID NO: 139417 - DNA, 1506 bp, Homo sapiens
aatgtttcttgttaaggtctgcttattagtttttctttattgggtattttttgagatagcatctcactctgttacccaggctggagtacagtggtgacgtgatcacagctgactgcagcctcgacatccggggctcaagtgatccacccgcctcagcttcctgagtagttgggactacagacgtgcaccagcaagcccgactaatttttagtttttttgtagagacaaggtctccctaggcttcccaggctggtctccaactcttgggttccagcagttcttctgcctcggcctcccaaagtgctggaatttataggtgtgagccaccacaccgagtcttgttctatagtttttgaattaggttcttctgaatatttttttctttacaaagttttgagaactacaccatctgtttttgctaccttcatttggatattggggatgtatttccagttgctctcatgatgcatggatttgatatgatgaaacactaatactacaaaaaggatgcatgcaaaataatatcttaagttaatatagtccctattcaatttacggctttttgttgaatatgtagtattaatactggaaactaaaacctgatcgtgaatataatattacaattttaacactgtcacatgttatttgtaattcatttatcagtttggtctttatattatgtatgaagcaacatttggttcttgcagaggaaaaaatttaactgtgacttacaattccccaatcacattagaatgcattttccgatgaatataagactaaaatatgcttatttcacctgcacattcttgattccttgtttaatttaatattttgtaatttggaagtaaacctgcagcatctggttattcccagtctcccatccaagcactaaccaggctagaccttgcttagctcacaagatcagatgagatggggcacattcaggatggtgtgaccatagattaagaagctatttatttaccaagttaacggttcatagattaatgtgctccccaagtgctctaggatatacaacatatggccaagagaaaaagccaatttagggccagaggaagaaatatcgtatgcatcatagtaatcaatgatggtacaaaaaataggatcattttgttaaggcttcattaaggggtacatattgaaagtgtagccttcagttgtatttcaagaacatttcatgaactcctgttccttataaagtagcaaggatatttacctgtcacataagaatacctcctcatttcactttattaactgatagtttctttataaagactttatgaaagaacttggatttacttctcttgcttaagtcatgaaagtaacaggatataattaaaccaacagtgcctaaacagatgatgcaaatgtttgggcttggtgcgatcagccttatcctggtatgtctgcccatttattgccgctctcttttctggaggaggtaggtgaacataaacttttatttgctcgttgctaagtatacatgag

SEQ ID NO: 139418 - DNA, 1755 bp, Homo sapiens
ttatacaaaatgccaatggactactagcatgatgcttccaagctttttttttttttttatagctccccacctatggggacagagtgggtatagaggtacagagcacagtcaggactagagtgaggtgagtgaagcacttagagcacaaagttaagggaagcactcactctcaggtttgtgcgcgtgcaaggtcagcattgtcactaccctgagaataagtacctccttaaattctctgataaagacaaggtgcctgttgaaggttaagcatgttttatgtttttattgaagttaatgtggaagtagtagttgagttaccagaatatggtttagatttcgcaagaagagttagactatatacactgccttactttggatgaagatcatcgaagtgattggcagtaggagtggaatttttggcccttccttcttctcttcaaaggttgattttgtattaaaaaaataaaccatgaataacaataaagtaacatttgctagaaattggtggctaggaatataccatgaaatttagagagtttctaggattataagtttggtatgataacttcattatggtccctgtgttatacctctgcaaaggaattttatgggggtgttcaggtcccctggatttttttttctctaaaatgaaatccaaaggattgtcctctgatcctaatatatttccttctttctacatagtacagactgcttgagaaacaatgtgaataagtgtatatattggatactatacattttggtttactatgttttatttatttattttactattttgtgcaagagcagtatgctccttcggtcatcttgagctgactatcatgacccttggagcaggtagcagattcatcttgctgcttagctgaatttccaggaacaatgattgagagtggatgggcactttcagcctattgtggtaggctgattttagaggcaaggagaataattgtgtaagaacggggaaatcccatccctgatatcaaacaaggagccaagtgcaggacatagtcagcttttgcagggcaagatatctccttagaacgatttccttaactcactttctgttctccatttcaaagaataaagagatagataaaatattagggtaggtaaaataaataacccataaaagagaaatagacacagcagtaaaatcaatatgtggtggcttaaaaaggaaaagaaagaagccaaacacaattgtttgtccaaatcagaggtaccaaaagctattatgactatctgcagtaatgtgatttgggcctcttttggaagacctttttttgctctttcatcattggaagatacccttaagctcctcctcctgctaaatcctgtcttaaacattaaataactgagaattcctttaagaaagagctgtcatagctctcctcttggccttcggttgcaagccaaaacaaacaatgttttggtattccccaacctctgcaatttggacagtgccttttttaaggatcacctaaggagccagcaactgacaagagttggagagcttaaaaaatgagaagcactttgggaggccaaggcgggcagatcacgaggtcaggagttcgagaccagcctgaacaacatggtgaaaccctgtctctactaacaatacaaaaattagccgggcatggtgacatgcgcctgtaatcccagctactcaggaggctgaggcaggagaatcgcttgaacccgggaggcggcagttacagtgagccgagatcgcgtcac

SEQ ID NO: 139419 - DNA, 1393 bp, Homo sapiens
aggggagaggaattctaaggggaagagaaaaagggaggtggctgaattgttcttattaacagctattactgtagccagcgacagtagtctcaagtgcagtttctaattcagtttctaatctttatctgtttttagataaagtttaaatctgtgtgtatatgccatttaaacatctgtggattatatagtgatatgatacttgagtgtgtctgtagctttggtaaggtggaaaatttaaacataataccatgcctgttaaattcagatgaagtgcattttcatgttctttttcttcctatcagattgaatttgtaactttgaattaagacaaaattcagaactcagtctgaaaatgacaaaactgtgttttctttcaactaataaaatgtctatttttttttgaagattgtagatcatctgatacacagatgatgtaaaaagcacatcccccatacactttcaatgttgctacttgccagatggctgttactgaaaatttctacatttagaccaatcctgctgcatgattccctgtattataatctggttttcattatgccgctagtcttagtgccacttattttcttacaatgggaggtaaagaactgggaataaatgtgtcaaaaactgcctaaaaatcatcaccctttgaatttaaaaaatagacatttacattttcaatttcccatgtttgcatatctcattatactgtacaatataattagtaatgttattttgaaaagctttatgcagtaattagcgaactactggaaagtttgaagttcctaggattatatacatctggattcagaggaaggaaataaaatctataaattttgaaaagtatgactaggctgtaagaactttgataaaatatgtcagatgagaatgtgagcaaactggaactctgttctagcatgagtcactataggtttgaaattcgtataaagctggtacttcttggacgctgttcatggtaatttaattactgaaataataagagaacctcattatgcggatcatatgtctgaggtgttctcattgcaaggactccaaggacagcattttagagaactctggcatagtaggtactattaaaaagaacattctgttgccaagtaactaataacttcattgcaaaatgaagtgtccttttctcaattcccatttaatttgatctttttgtcacagagtacactgttgactgctcccttcttgaaattttccccccttggatttcattgttcctcttacaattttgatccatctcagtctgcttttctttgttcacccaaatgtggttgtttcccaaagccttactcccatttatcagaaaatgttagaaatatatagtaggaagaacattctaaaagatctgcgttctcattctgct

SEQ ID NO: 139420 - DNA, 1077 bp, Homo sapiens
agtgatttctttagtttcccaggctagaaccttagagtctttggtgactatttcttctcatttatcctcaatatataatcttttcacttactctccttgtcattgtgttctgttttgttttgttcttctttggaatgagtctggaatttgccccttctcccattttattgtaatttagtaccagccttgagtgccttttcccattctaggcaagtggcttcaggagaggagcaaaagggaactaagggtagcatctaaagagcgaaggcaggtttcagagctgagaggtcataatgatatatctaatccaagagattcttataggagagacaccatctgagatggggccgcaagtggggcttggaggatggctaggaggtgggttccagagaggtttcctggtacttaaataggaatgtatagcattggccttaggtaaagaggaattaaggatacctgccaaaccagtttggacatatacctggactcctaatctactctccctctaatccatcctgcaatgtcttgccagactcatcttcctgaaatatctctatttcatttcattatatcattcaagaacttctaatgctttcaagaatatctgtgttccaggccttgtgttaggtgctgtgaaggacaaagaagcaaatcagattatgctctgtgctctcaaggaacacacatagtctgtgtaataagggacatatacaagtatccaaagtagaaaatcattgtccgtaaaagaggtacagataaaaagttagcatgtagatggcttctacggaagtaaacttgggaatttttttttttaagacaagttctcgctctgtcacccaggttggagtgcagtggcacaatcacggcttactgcagcctcgacttcccgggctccggcaatcctcccacctcagcctcccgagtacccaggaccacaggcgtgtgccaccacacccaactaatttttgtatatttggtagaaacagagcttcaccatgttgcccaggctggtctcaaactcctgagctcaaggaatccacctgccttggcctcctgaagtgctgggattacagacag

SEQ ID NO: 139421 - DNA, 1251 bp, Homo sapiens
ggtacgagattgtatacccaatgacaacaggagtaagtgaaggtgctttgaaaattgtaaatgctaatacaatgtgagccattactgtgtagatttgaagttcataggaggaaggaatccctctaaactaggagtggaagagctggcttcctagacaagataatatctaaacttaccattaaagagtgggtaacattgatgtcagcacagggaagtgggagagcatttctgttacagatggtcacataatcaaaatgactgtatagagaataataatgatggttatgatgatcaatatgagcaagccaagtggaataatttctatcggatttattaaatctggtgagttaaaaatatcaggtgggaaagtatagttatctgggcaaatatttttttccttataaccctcccattgttattctatcactaatgagaaataaggtttcacttgaactttttatgttacagcgaaccggccgatgatttacaaaggcaggacaacagagttgtaacgggtttgaagaaacaaagaaggaagcgaaagaggaagtctgaaatgttacagaaagcagcaagaggacgtgaggaacatggtgacgagtagcaagagaccaaaggtaattgacaataggatataaagttgaagtgctcaatctctgattcttgttagctttatatttctaccatcatcttggcttgactgacacattttttttaaccacacaaatgtttggatcacaggagggccagcttctgaacacatatttatcactagagatattgagatggtaggaaaatggataagaaatgtgccaaattgttttgagtgccacattatatggtatacacaggtcagcttttcagagggagaaaagaagttgatcctgcccactctgactctatggctccctgatagacacccttggtaaataatgaaggccacagtcctcatatgtgaccacatcacatatccaggggaaggagaatggccttaggagtctgacagagatgagattgaatcctggatcttacctgttagtctcagctacctgttcttcaaacctgcacgatgtagtgttagaagaggttgagagagggatcccagaatcatacactagggactactttgtacaggttatacttgtacagggttatagatccctagccttgacttgggtctcctcctcccaaaataactgtgaagggacaagtaagaataaaatggttggtgagaaacaaagctgtatctca

SEQ ID NO: 139422 - DNA, 1001 bp, Homo sapiens
tttatctcagaagaaaaaaaagaaaatctttatataaggtatcatatatatatatgggatacatatttacttaaggtaacacataaatatgtattactataatgcctgtgtattattattcatataaatatattaccttgtattagtttaatgcaatacatgtgtgcatatgtacacatgtacacacacatatatacatatgtaacattataactagactaacaaaacttggtttctgtggaccattcactgagacatggaagttaactttgttattcagaaattatctctgtaatgatatttgctctaatctgttttatatgtatgcctcacagtaacagaagatgatgtactggcaaactgaaaatacataagttaatcataacattcactatatagaatttgataattttgttgcagggacttcttttatgacaaagtgcgatatgtgaataccagccttttcaagttgtttaaccctactttacttttctcccatagcattattttcccctcaagacaacagaaaccattcagagcagaggggactgtctcagccatgcaaacctcatggagcattttggaaagttaaaaattgattcttatttttgtcatgtttactttcaaacatgaaataaaattgagttctgttttcatgcatcaaaccagaatctgaattctttttattaaaaacagttcctacagaatctttaaaaacatgcctaaaacaccggtggcattcagatcctaaaaagttacatgatttttgcaacttgggttattgtatcaacatatacttctgttggtactaaataagacagatgttccatattgttattcacctgtcagcaagcagagagaaaaaccccaatgatcatatgttgcagtgtgtgatactttgtttattttgaggaaaagaggtgaagataatttgtagggtttttttattttataaattataatgttatttttcccactataaaagtaaaatacacttacag

SEQ ID NO: 139423 - DNA, 1029 bp, Homo sapiens
gtcatcatgtataccaaatgatcaccagagttcagtaaacaagtgtttgctttgaaagttatttcccaagaatctgatattgctgctctaaattttcagagctgtattcagcaaaaacaaaataaaaagagcaacaaaaaagtttgttgtgtagaaataaataataaaataacacataagaaaacaattcctttagaacaagcttgtccaacctgcagcccatgggctccacgtggcctaggacggctttgaatgctacccaacacaaatttgtaaactttcttaaaacgttacaagagttttttttgcaaatttttttaaagctcatcagctatctttagtgttagtgtattttatgtgtggcccaattcttcttcttccagtatggcccagggaagccaaaagattggacactcctgctttaaaacctaatattgaaattttagtgaagccatttgtaatctataaagaagataagcatagtctgaagtaatactttgaaagcaatagagaagaattatctgcaactattctttaacagattagaagttaggtttcagggtacacagacaaagattatcattaagttgtcaaagagtgtgagcttagagtgactgttgaacagttagtgctgtagaataaatgctggaccagagatgagaattgaggcaatcgaaggttgttattattaacgattaaatgccaaagggactcacaagagtgggaaggaaataaggttgttcagaatgctgtctccaacaccagtgcctaatgcagtaccaaatcatgtctgacatggatgtttaagccctgcaagtcatagatgggtagataataagtgtgtcactaatgtacaagcattaatggtcacagagtcatttccctcaagccatgaccatatctgttccaaatgaaaagatactagctaaatgagaagctctctgatgaagagcctgaatttaacttgactagggtgactgctttaagccagaggtgctagacaatctccttacttccacagacacaggg

SEQ ID NO: 139424 - DNA, 1723 bp, Homo sapiens
ctgcaaaatattggtttcattttaataggaaattgtgccctagtttgggaagagcctcatgagatacaacttccatgacttaatcctaaaaacttattcacttgaagtacttcctaagggaaacttcctaactacttcctaagggaaaaatctgtctctgcctgtagatactatacaaggaggtaaaatatctacaattttgaaggcaggtacccaatttcacataagaaaacaaggttttggttagatccctaaagcatatgaatctgccctcaactagcaacatagaaatccctggttccaggcttcctctgagtggacaatctcaagctatctgctattctgtgcttattggaagcccaactgcaagaagtgatggttagagaatagtaatatgggctgacgcctcactcgatttcccacagggctgcgcaggtttcccctttctgcgaatggaccactggaggggttcaaagattccagttctaatatgggaatgagcctctttgatctcttccggggctttttcggctttcctggacctcagagctacagagatcccttttttggagggatgactcgagatgaagatgatgatgaggaagaagaggaagaagggggctcatggggctgtgggaacccaaggttcgataatcctcagcatcccgcccctccccgccgccccccctccgcccccacaacaaggaatttggctttgacttcagcttcagcccaggaggagggatacgtttccacgataacttcggctttgatgacctagtacaagatttcaatagcatcttcagcaatatgggggcctggaccttgccttcccatcctcctgaacttccaggttctgagtcagagacacctggtgagagactgcgggagggacaggcacttcgagaatcaatgcttaagtatccagatagtcaccagcccaggatctttgagggggtcttggagagtgatgcaagaagtgaatcccccaaaccagcaccagattgaggctcccagagaccatttcatgggtttgatgacgtatggcctgtggacccccatcctagaaccagagaggacaatgatcttgattcccgggtttcccaggagcgtcttggcccggttctacagccccagcccagatctacttcaagagcatctctgtgaccaaaatcactaagccagatgggatagtggaggagcgctggactgtggtggacagtgagggccagacagagaccgcagtaacccaacacgaagcagatagcagtcctaggatgatccaaaatcaccaagacctccagctctggatgatgccttctccatcctggacttattcctaggatgctggttccggtcccggtagccttgttaaccctcagaggccttcaagtcctttccacctctcacccattgcccaccatcaataagcttagcttctcctcttgccccctcagggtcttggctatgtggaatagtgaattgggggcatgtcagtttgtcactcacccaaactgaccaataaaacctttatttatgctaaaaaagagaataataatatgaatatttatgactaacatttattgagtgcttactatatacatttaaagatccaatgcattatttcattcaatccttagaaaactatcagtaggtattatattttttctcatgctatagataagaaggcagatgaccacagaggttaagaagaaaacaaatg

SEQ ID NO: 139425 - DNA, 1804 bp, Homo sapiens
agaatgtgattttgattatggattgcttactttatgggatgctgtttttcaaacatacctgtgtattttgcttcatttgaaaaataaaatcagctaatgtttcaaagtaatcttcgatttggttcttcagtaggtacgttctcttatatgaaggtgtaaaagccacactttgaggattaagctaaggaaacaagctttgttttcattacaaaatcaaaatcactcatctgtttatttttccaatgcttcgtttgttggagaaataaaagacattacttccatcctatggagaacagtttgttttgttagatttccaaataatagttctctgcatcatctaccatcttcaatgaaaaccagatctcagtagcagatactggttcacttggtgacctttattaaaccattttcctggagtcagtttttgtgttttgtaggcaacgtatctcctggaaataaatagctttgaaatggtttcttttttgtataagtaaaaaataatatgctacttgttttgtagtggtgctgaaattgaaatctcagctttaacaatcattggaagaagttgcttgctaaaattgtgatgtcttcttggtgtttgggtttctagtatggtttgatcaaaccaaccaagcagatggaatgtgttgttataaggtcattttaacctgtagactacggcaatatgtacatgacaacctgactatctgttgaacaatgaaaaatgcaattacgtaggctttatttcccccttcaggatgtcagccaacaaattttttaatgaattaattttccaaaggactgattgttttcatgccaggtcggcacaaccacagtgactaaattagactcagtgtgatggatgtttctgatgaagtgccgtggagaggtctcatcaatttgctattatttatttgctgccaaagtgcttggctttggtgtgtagacgttaatcaggtcgtagaagctagagttttaaggctggagggcccctttggatcatgtgatccaaactcctcattgtacagataaggagactgaggcccaggatgggaaaatgacttgcccaaggacatccagtcagtaattggcaaagccgggtcaggagcccttgtaccctggttcagtgtttgtcatctctcaagaactgtttgtattgcctacctactctgtgcccaacactctgctagtcagtcatttttagggagagatgaaaggaccgtagaagatgacctctggcctcacagaatttacattggaaagtataattagaattagggaaatactatgacatggactgtaagtaaaacaggaattctgggagagagagagaatgcaagctaagtaggcaaaacagtcctggtcaaggcccatgaaactcttttattactattagtgcacttcagagtgaaatggaaatccagaaatttttattgtttaggggacccggagcattgaatactcaacataagacaattgactttggaccctgaattatctggtttgacagtagctcacattcatcacataattgcctgagtcctcttttgctgtgtgaatggagtattctcattaacacagaccaacatttgctgagggacaaccacaaaagtctcccaagaagagctttggaaacatttgtgcaaacattcttcaaagaaataccaaatgaaaatgtgttttttttctgaaataattgaaacaagtgtttgtaaattggtacaattgctagcaaaatggccatttttcaaaagaagggtatactgtagctcttgagatgttcacaaatacattgtttcttttg

SEQ ID NO: 139426 - DNA, 1143 bp, Homo sapiens
ctaggatagatgctatactagtggcaagccctgcttgtgcttgggctctatagtagactgggctaatgaggactttaccactcatccttagtatttacaaattgggtctaagttcattatcaaatatgaggcatgactttccagatatctactccaacaagagacacacaagtctgttcctctttggtgtaagtggcagattctgatcttgggaggaaggtatactggttcaaaaacctgaacctaattcaaacttgacaagaatgtgagctcattaagggtggagagttttgttggttttattcactgctgacactgcaatgcttagaacagtgtgtggtgcacagtaggtgctcagttattttttggtgaataggtagatggaatgatagacaaaaacctgcttaatactttgtgtgattaaatttgtgaagagatagctcaagaggtgtaagaatgaggaccaagagaagtgctaaaatcacaatgagcagacaggtgggtacaggtaggtgtgttgccttgccttctgtacatacttttctgaaataggatgcttatagaaatgttataaattaaatgttctttatgtgcatcttacttgccaggaataccgtagggaagtctttgttgatgagcaaaatctctcccaaacagccctaaacttatcagatttgtgtacagcattttgagattttagatttttgtgtacagcattttcttgtcatgaggtatacctacatttaatatctgcaacagtgctttaagggtaattgggcagccttaaaaaaaaaaggtgtagtaacttgttaccatccctgaattgtagctttcatctagtacaaaggggggataacagacttcaacatttgctgagtatttttctccgcgcttttgtaacgttgtctcctcttagctagatgcccgtttgcttaatagttcccgctttggaggctaacctgggatttgaattttcctaacatatatttttacattgaacacattttctatttatgcctctggaggattcaaattacaatttcatcccaaggatgtgcagaaaagtttccacacgtgctgattttaaagaaatctataagataatttggtagggaaagaggattagcatttacagagcattat

SEQ ID NO: 139427 - DNA, 1050 bp, Homo sapiens
aatttctcagaatattcccatcttaaagaggatgtggagacaacatttgaatggatgacattatgtgtgtttcagaagccaggtgtaaagagcacttttccatacattttatatctgagttaccaatgcctcatcttccagagagcaggcagtaggcggcatgtgtgtcctgggacactgagcttgccttcctttactaagggctgtaactgccacatcaccatttggagtcatgacttgtaaagtactcagtcttatttgttgacaactgttgtgggcacctctcccttttaagtgttctaaaggaacaagttttgagaaattaggtcagttgaattttctaatatttttggaatgtaaattaactgtacaaaaagcttcaactgcagttgtaattgtagcttgttaaaaatgaaaaacagagatgtcagaattctattaggaaaaaataattatagtaatattttcctgctatattgaccctgctaattgtataaaagaaagtacattcaaaatttaacttatgtgtacgtgtgtgtgtgtgcatgtgcaggagagagagagaggtgttagagccaccagtttgctgaagtaataactttccttttcttcttttctataaccaagcataatatataaagagagctttgacataacatttaaagtctaaactccagccaatgtcaatattatatagcaaatattgactttaatcaaaaaggtctgactgatgttacagcttataagaacaaacaaaattgtaacacttatcattaaattaccactatagaaatatgtagatgataatctcagcccagtgaatgagctgattctcaatagataatggtcccattagtcagatattatcatttagcttatctatattacttagaaatagtttatatttaaataaccagaatagaagacttcataaatacacattaggttgtgggctatagatttcaacactatctatctatagataaagctataaatagatgaatattgaatatagtaatttaacacttaagtaattttatagtatcatta

SEQ ID NO: 139428 - DNA, 1055 bp, Homo sapiens
atcatagtataatagctttgactcaataaagtgatcttccgtgagcaagaagatcagttggcagaaaaggaaaaggaaatgtggcacaaaaaacttggcactccactataagaaataactttacctttgttaattcatttagtcggtggattcttattttatttaatgagttataatccattactatcatcatttatttatttattgctaaaatttgaggtaattttagattcacacatagttgcaagaaagaatatacagaagtcctgtgtacttttatccagttttccacagtggtaatatcttgcgaaactatagtacaatacaatcttgttttttttttttttttttttttgatgcacaaattttcccagacttgaccagtgggagctgtttctagctggctcctatgtccttttgattatgaatcacttccttaatttctggaacaaaatacttcaggttcacctggtactttctctgcttcagccctggattcatctctcttagaagcctaatttcctttattggaaaatggtacttatagaacaagatatagaacaaaatggtacttatagaaaaggggataggtatacctttactaccggagtgccattatttctaggccatctcagcaaatagagctaggaaatatatacacgtacatgcacatacacatacatgaacacacatctatctctatttctatatctgttcatctgtatatacagcatattaaaatatcatgatgttataatgatctcaccaattccaataaaacaccacattccagtctttccccttttcttaccggtaactcccttctctaaaattgagaaatttagctcacatgatccacaatatacttagttatttagtcaatccaaatgtgctaacccctagcactgtgaaaaatcagttcaggtaagagtcatcaatggatcataaaagcagtgggtgaaagtttgaggagtaatgaaatatttacataatttctaagtatttccctacaaaatatttattaattgcaaggggaagaagtagcaaattggcag

SEQ ID NO: 139429 - DNA, 1129 bp, Homo sapiens
tcttctaacctatttgtgtagatatgttgcacatataattgttgctacctattgcaaggtccaaatgggtaaaggatacacattttgatcttctatactaggatattcttgagacctcctaaaagggagcatgaagaactgaggcttggctggctgctgggcagaccactttgcttagcagccatccatgcagacaggtgcccacaggctgaagggctgtcaggggaaggcagtcacagcaaggaaggaagtgggataggaactgaaacaaagattatttctcctcatatatttatgagttcctctaggtgggctagagcctagagcgaggagaaactcggtatgtattgttaaacagaatggattaaaaggaaggggactgtggcttaagaattcattgagcagtctatcttttgggtcatccccgtcttcatcacaagtaagtccacacctggaaatggaacttttccctccaaaccatagagttgatcaccagggggagagctgtaatgaaatctgtttctgaaaccagttggccttactgcttctgtgtgagttggtgttagcaaatggttgcatgaaaccttcctgatgacttaccatcctctagagggcagagccaggactggatccgggcctcctaaattgtagaccctggtattcaaaagggggtccatggaacagcagcatcgacctctcttggtataacttgttggaaatgcccaatgtcaggtgccagccaaacttcctgaatctgagtctgcattgtcaaaagatccccagggaatgcatatgcacaataaagactaaagagccctgctgataggcttggttcattgaaatgtgaatcttatgtgcaatgactaaagattgtgttcttttgccttacttttacaaaagaagaagggaactgatcttgattggaccccctaccctgtgccagtaactgaatgtgcctggcatcctatatttctgcttgttcaaccttcacaactaccctgggagataagcactgtcttcctaatcttatagacaaggaattctaagctgaaaaacaaagtgacttgcccaaggccacagggtaattgtcaaggctggggtttgaaccctagtttgtgtgatttcaaag

SEQ ID NO: 139430 - DNA, 1054 bp, Homo sapiens
agggagaaagggtgatgtggtaggacatggttcagaatatgaactgagaataccatcttaattagaggtctccaattttttctttgcaaaaatatgcttacattattattataacactgtttcagtgttatacaaaaataatgattatctattattatttaggtaaggttatataaattattatttagataagatactgttatctctctttttgtagtctgctatattttgaacactcttcacaccattaaatattctacgacagtacatttctgttcatgctgatcaaattagattgtggtaatctactagatgtggtttgtctctgccattgtatgtgaaactgaaggcctaaggttaagacttgtttatctctttctgcatcccgatggctcagcatagagtaggcttcaggaaatatacatttaatgaataaataagtcaatagataagtgacctttgattcctactatgtgcatattattgaattagatttactttgtgattgcttggaagaatttacaaagatgagtaactgacaatgtttcaaccctcaagggactagtgatatatttagaagctgacaaccggttgatgattgagatgttgcttttcactctgtttttatctctctgtctcgctcatataactctatcacttagctatgcagtgtttcttgggctttgatagcagggtaaccacaaaagaagagatcatacttgctaaaaactcccaggtttggagtaaaaccaagacatttcctattgggatgagttcctgtattaaaacagctaaaaatgaactatgatttctattgttttctaaggcatgattgctgtggctggaaatcccagagttaatacttaggaccctcttgacagtcactttctgactaaaactttatagttcttaaagacttccaatttaatttaggattcctaatgatcttcattgttgttttttctattataaggctgtagtctataaatctggaagctgttcagcatgcactaaaaatgtcaatatgtttcaaataagtactgttgcatctcat

SEQ ID NO: 139431 - DNA, 1018 bp, Homo sapiens
cctagttgcttctttcatactttataccaaactcaagagaagaaaagacagtaactttcctctttgcttgcatgggattatatcattatttgtctgtgtgcctgtctctctcctctagcctgtcagcagttcgaggcaattccttatgtactcattcaaaagatggtcatttatctaacacctactagacctgagcatattgcttaatgttgagaactgtcctctccaattcatttcaggactcgcttagtcctgggctgtttctggatgtatcacacacatagtgcatcagttaaacatggagactctggagtcagcctgcctgggctggattcccaactctgctggaatttgctttgtggccttgggcgggttatttcccctctatggccctcagtttcctcatctgttaatgaggataatagtatcaacctcataaccttgttgtgagaagtaaattagcccatgtaaattgcttagaacagtgcctgaatagacactcaaacatgttagttcttggtgcagctataagaattgctattactatgttacatttcaatcaaattcaagttgtctgggtggtccatggtagtgctctgttctgattcccagggtctataattaaagaaggtggattcttagacaactaaaactaggtaggtggccttgaggaagccaggagaggggaaggggacctgaatactctttaagtggatattttgcagtctactatttagggagtacagatctctgagctagtacctctgggtgcttgccaagattgcttttgctgagcttgtaagtagaccatgagctagaatggaacaggaactaggggctccctagagagtaaaactaagcttgcaagacagattatatagattcttagctcactttggttaattttctagttgtttttctcaagcctttagtaaagtcttacttaaatgctccagccatgtctccgttaagctgtgaagtagtaaagtgcaaagtcctatgtccatactctagccag

SEQ ID NO: 139432 - DNA, 3062 bp, Homo sapiens
ctgtatactaaaaagtggttacgatggtaaatgtcatggtgtgtgtatttgatcgtaataaaatgcaaagataactctaatgcagacatccagaagggagtaatgtgtggggtgatcctgtgggagtcagaatatcctgttcctcaacagactcttttacctagtggttgtagccttaattgatgatccttgtctgagtcagttattaaatcggtggttccaaaattcaggttgttttaaaaagcgccaacagcctcgtggggccctaattttgcatcctgctatttgattggatgagtaattaatgcagggtgaggtgccgaggtggtgtttctaaacgtctgttgctaaagataaatgttgtaaattaaaaaaagaaaacatatggagcccagacaggttcctttactgctcctgcctggccatggcaggcttttataatgtaacccattctgctctgtcgcttcctgtttcaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttcaaatctaaagttaaaaaaaaatagcagaagccagtgtcttaaagtctatcttttgtttctaagaccatgggatttcataatctcaagataaaatatgtatgaagtaattaatgtagaatttttacaccaaataataaataatgcttaataaactagagatatgagatgtgtaggaaatttggttaaacttttttcagatactttctggcccaaataataatttgttagcaaataatatgacccttgaactcaatggccatctattaaaagactgttgttcacactggaaaacatttaaagatgtgactatatccatgggtggattgaatcactcaaaatatattagtatccttctttagggatggttggttacagacatgtatttattcaggaggcagaaaatattccattttaattgcttattaaagaaaacattaaattctaaattattttgaggactgtgaagacttttcattagtgtaatattaggtcattgtcaatctcccagaatgtagttctatattctctaaatatgaaagtatccagaaaggccagtggtagtaaaaagcttagtgtatataatctcaaaagggatggaatatttacagctcatatttataacatgttgaatcttctcagttatcagtagtcatcagaagtgtcaatagctttctaaataaatattaaatatctactgtcctgtagtgaaggagtaatttttagtaattttctctttacaaagtctccagtgtttccaggtaaatatttgtgaaacaaaatacagcaaactacattgttacttcagtgtattgttgccaaaaatgacaagatattatattaaaatcagtaaattttagacagattttaaaaattaattagcctacaatagaggttatatggtaacacggtgatcttctaagcagttaagtgactgactgttctggcaacaacgacttctccgtgactgaagggccctgttcatttcctgatcctgaagctcgtctctcttttgagcctccgcttgctttggtcgatggtttccctcagctttttctttgctgttcttcatcctcgttgttgctgtcatcatgttcactgtggcttttacaatacagcctgtaaattccttatgacatagttcagtgcatttggctttatcgcctgctccacagttctttacctttacttggcttagagaaactgtatctttgttgcttcatataacctttccccaaccccactaagctggacataacttattagtggtcctcccgtcactttatttgtagaaatctctctttcacatgagcaggggttctttcatgtggtttagctgacagcagaactagtgattctagacattttgcatggccctcattcagtggctcacaaacatgagggagcatcagaactacttgaggggcttgttaaaacccagtgcgttagaagtcggatgcggtggctcacacctgtaatcccagcactttgggaggcccaggcaggcggatcacttgaggttaggagttcaagaccagcctggccaacatggtgaaaccccgtctctactaaaaatacaaaagttagccgggtgtgg

SEQ ID NO: 139433 - DNA, 1046 bp, Homo sapiens
tcgtcctccccgagagagtggagaggtcgagcagtggggatgcccctcaggccccggggcttactgactggggcgggtgtcagggggaactccctctctttctgagctccactgagctatctgaaagtccccaccatactccccagtactgacagccagagggaggaacggctcaccagaatcattgggcatctctgatgggcatcaagtctgctttgattattgatgagtgggtaagagggtcctctcaacttggggtctccttgggaaagcactgtcaactcagaacaggtttcagccctgttctggagaccacaggccctggaaggctgggacatcatttgcagccccagcgtcatctattagacggagccagcaaggtctcatgctgtgcggtacatttcaacactttctcaaatttacccgtggcagcttttggtgtgtttggttatttttataacactactcactgtacaatttctgtcatgcacattttttgtatcaaaaagggtgctgtaactttaaaagactgggtatttccaacttggaatattcaaaccatcttttgcaagggatgttttaaataggcatgaagggttgtttttaattgaggttaaggatctgaaatgagaggttttggtttaccctatctatggtatgtcttaaaaatcaacgaagatgtccttgtcttttttgaatttgccgagtgtgttgcagttccacagctcactgttaggtggcacataccccaaactgaaaacctgacctcgtagggcatgagtcaaaagacaggtaggcacaggacagggcagtggtgacactacagctttcagggttcccagcctgtcaagaatgagcatgtcttagcaggggaggaacgcatgtgtgggaaccgccacagagtcctacgttaggtatatgttgctagtagtttgttaagatatttgagtttgggaatttaattattttttcttttttaaaggtttcctcatgaggacaaatacctgattttgaataaagcagcattcagttgaaataaccctttc

SEQ ID NO: 139434 - DNA, 1081 bp, Homo sapiens
tttgagagcctctgctgtagagtattgtttaaagcaaacacagaacaaaaccactgcatacagatatcccttgctatccaaacttacttggcccctgagtttgcacaacaagagtttggttggtgagaggtgtacattcctcaaatgtatttgattcctgtttcactgagagtttggaaagcaatgcatccatctgtttgttttctaattttgtgtttctgggctcctgatggtgaagtggcttgaactggctctgaggctgcacctggatgctttattagtgatggtcacttaaaatgacccttcaaaatggactgtgtgccaggaagggcgctgattcatgtgtggtatcgcctttagtcctcatggggacttagtgaggtacctgctctctgttgtctaggtgaggaaactcaaggcatgggaggtgtgctgacttgtctgacagcacaaaattagtgctgggtggagccaattcatccccagggactgtaactccaaagccccatggttggatctgttggttcccagcagtgtgggttcgaattcatgttctacctcataccagctgcctaacctctgtcaagtcatgttacctccctgagcctccctgagttttcttctctataaaactgaaacaaggtaggtaaagtttttccatgataacacctactttagagattttcagcaagaaccaaagagagcatgtagaagtatctaggaccgtgtcggctgcacggagctatctccttcaagttctcttagtcccctccttacacacagtggacagcatgactcagagggcctccctgatgcctgcatgtgctggtctcagccctgtgttccccttgaactctggcctgctcactgtcctcttgtagctttggatgtccgcatccaagcccatctcactgcacccttgagactcagctctgggatctcttcagctccagccctctaactcagctctacatgagccagtgacctcaggggccacactcaggagtttgttgcctgctccttccgagtcaccatactgaccacaacctcttctcctagcacttcccttgctctacctcac

SEQ ID NO: 139435 - DNA, 1026 bp, Homo sapiens
agccacatttccatgttcaattggccatttgtatatcatctttggagaaatgtctatccaaatcctttgcccatttttaattggcattttttaattgttgaattagagatggatttttttttataattagtctatcggggtttcttttaattagttatgatctggagaaagagtattagtagcaagaaaccaagtgctagtggatttctggcccctgcctggaaaacaagaaacaccttttctgtcttagttctacttctgatgtctctgttcagtctgagtgactaacacgtgaagggctgattatgtgaacattaaatctgtgtgtgtagccttcatggcttcatttcttgcacttaaaaagctgatgttatattattttgttttgaaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggtgaagagctggttgagggctgatccagcacagctgtgacagctgtgttgtttgttgagggagggatttgcacagggaaggtggctacatcctgccatcgccaggcaccatggttgcctgatgggcactagtgtcctcagtggagtaaagatgggatttagaggtcaaggccaagaacatgtaagaatcttgtaagaaatgcttggctttccgcttcactccactggagggtttgatttcctttccttgaacttattgagcagatgttgggttggatggtgagatcaccacagagtagtgaatcagagctggctgccaaagcctgtaataagggatggcccttccaaaacagccccagggaatgtgaaactctcttcaaaaactgcctgttccccctgagcctgtcaggttagatcatctaaacacaaagcac

SEQ ID NO: 139436 - DNA, 1030 bp, Homo sapiens
agcatagtctggaaaatggtagtggagaaaatctggttttccactcatgggaaagcttgaccttcaagggtggccttctccttgggtgcaaggtgcgccctggccctgatgtgttcatggcagccctggccagctttctcccagaacgggcgcttgcctggtgctcagaaggaaggggtgctgcagaagggcacccacaggtctgcaggctgggcctcaggtgagagctagccagggtggccctgctccctgaaccccctcatggctctgcccccagcaacactggccgctctgtgtgcctggggaggccattgcgtaggaggagataagcatctgctggtttcaggggctgattgcttcccttttctctcccggaagcagtctgttgcctaggtgacacccaaatcccagtgtctggtttgagctctgcatgactcagctaccaagctgtttgctaggagcctcgggagggcggttgcttggttacctaagagatggcagacatgttttgctgtggcgatgcttacctctgcttctgctccctaacagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctggtactgctccatgtccagagtctgggttctcttggtttgtggtgtctgaatccagcattcccatcctggggatggggctgtctttgcagagccctcttctggctgggcgagtccctcgctagtcagtgcttcctttctaaaaaactgacttgtcaacccagccacgttttcacccaaagtgaaaaagggtagaaagagctttgcttcctttcagaaaccactgagggtgtgctgttgggtctttcagctcctcgggtggtagggaggacacaggctggggaggtggcagtgttgggtggagtc

SEQ ID NO: 139437 - DNA, 1071 bp, Homo sapiens
gggtactcaagccctgttcaggctttgtgactcaggagtctggataaagtatgttatgacattgtaggagtgaaacttcttgttacggaaagaaagttaacaggaaggtcagttgagcctcgtgtgtgaaataaaaaattcttatttttcagggtggtttggtatccgcaaagatttctgtcagtttctgcttgaaatcttcccatttctacgagaatatggaaacatttcctatgatctccatcacgaagataatgaagaaaccgaagagaccccagttccggagccccctaaaatcgcacccatgtttcgaaagaaggccagggtggtcattacccagagccctgggaagtatgtgctcccacctcccaaattaaatatcgaaatgccagattagatgccacttccggggacagagcttaagtggactgggacgcactctctccgccttcctctgccccctcgttcaccccgcagaccagaaccagtactggagctgggtctccaggtacgtccatctcatgccttgtttgcatccagcgcctatcagccactcaccacgacgggacgcggaagtggcaggtgacgggggtgtgtgccagcagatgcggatgccaggaagagtgtgagaacaggggtgggattaccgtctgtctgggaggggctccaggtacccctcttccccgtcagacccactgggagatggctgcttgccaggcccccagaaggaacatctgtctatacggtgctgaaatcccaatcaaaagtattgtttagaaatgtatttctccacagggctgacctcctgcagctcgctgagcactcccaggtcctcagcactcccaggtcgtggctggggcagtcagtaggaactgtaactatgtctctgatgcaccacgtgtttagacacagcacagtccttttttctgttcctactgtggaagtagtttctctttgggcatgctgacagcagtttttcatagcctcacggatgagccctttctacgggagtgactccatgcttgtatacagagtatttatacaaatgttttagcatcttcatatgcggtg

SEQ ID NO: 139438 - DNA, 1008 bp, Homo sapiens
cagccttttccagtctctgtgtcttggtatagctagttccttctgcctggaatacttcctcatctcacttgctttcctgcctggcagcttcctacttgccctctggaaccagctctagggtcaccacatctctgcttctgagtgcctcctcagacacagtctgtatttcctcttccaagctctcatcacaaacattgtgctgtattatatgtttctgtgtggtcttccttctatgaggaagccttggaaagcaggagacttattttagtcttctttatgtttcttttattcccaacacattatgtctgccccatagaccttttcaataaatgattattgagttagtgactccttttacatgctgacaaatgtggctcttattactccccatttcagtatcacatatttgtaaaagtgaatccttcttaatcgttttacttttctcctagtaaattcctcatctatgcctgtctgctgctgttctctgtgctgctggcccttcgtttggatggcatcatacagtggagttactgggctgtctttgctccaatatggctgtggaagttaatggtcattgttggagcctcagttggaactggagtctgggcacgaaatcctcaatatcggtaatactgctttatacaacccattggtctctagcatgagggagcaatatcttgacttttctcacttttgatgaagtaaggaccattttattttctacctatctggggtcttagaactatagtataagctaacagatctcttctgtgtttttgaaaatttagtctttggtatgtattttcttacaaaagcagtgccatttgggggtaagttgccagccagctcacagatgcctatataatccaaaatgcacccaaaatacagaactggtatgccatactagactaagcagcatgaaaccaccctgtttttaggaaaagacactcatattatgtttggtcatgaaagatctttctccaatacagttttggaactggggctccc

SEQ ID NO: 139439 - DNA, 1052 bp, Homo sapiens
atatcaccgaggcacctaggtctgcgtggagagtattcttctcaccttcttgtctgcctttgcctgtaacaatgccactttcccaagcctgggtcctggttagtggccatatccaataccaggggtcagccctctctcctccctgactggcctgcttctgccattgaggccatgatttcaggtgcacgagtccaatgttaggacaaacagccacttctaaaccaaagaccaagtaagcaaaccattctcttttaggctaggaagtaggagaaagcatcatcagtatggtctgagaagcagcagtcttggaggagtgaagcagacatacaaaaagcttggctgtgtctatggcaactaggtgcagttgtacaacctcccaaaggctagaaagcccacttcccttgatgggagggctgccctgggaagtgttggccaacagaacaggggttgctttgtgggggatggggacctgccagtgcagctcctgacacaccaaaagcgaatcccagcatctcagaaactcagcgtcacgttccaaagagagaaaaaatggcctaccaagagcacttgtttattgctcagaaccctggtgtagcccagctctgcatatctgctggctaagagaatgtttgactaagggatgcactcagagctcatttagccaatgagcctttcttctactggtgagaaaactgagggctttttctgccctctgcatggctttttagaggggttgctctaaccacataccataccatgagcttcactcaaaactcgttgcaaacaatgccaagccttggaaactgtaccaaagcactctcaccttcctgtgactcacagtgcttgctttattccgcactcacctgaccagtcatctcagtgactgctgattttggttcctcagtttgggcaatccacttggacttcctctggcttgtagacttgaaaataagtctacaagccagagaaaggcttgaaaaatacctgagggctgtccctcaggtatttttactaccctggctgtgctgcctcagcctgtgtctgtaaagaga

SEQ ID NO: 139440 - DNA, 1050 bp, Homo sapiens
gtactgatggggataaccccaagcttaaagagggggcccttttcctccagggcttctagtgccatagtgctttccagaagagagagaaagagagagagagagagagagagagagtataccaactaatgagtggtatgttgtgtccctgcaatggacactggaacagcaccctccaacacacaccaactttggtggtcgactatggaaaagcttaagggaattaagcctgtaggcatttagctcatgagaaaactagcacggagatcacttgaattttcagtttggactgccactttaaatccaaggtatctttgaattctcaaagtgtatgatgtttatagcataggaaaagatgatgcttatagcataggaaaagatgatgctaaacaagttcaacttttctttttcaagaaataaggacttgaaaaaacttggactcacattactttgaaggctagttctgcagtcaatcatgtgacaagatgagcattgctattgttggtgtaagatagtcttgctctgccttcgtttcttgatgtccccaagttccagaaaactctgttctctgccataatgggaggtcactgtgtgctgtttgattttagagtcaaataagttttcagcacatggtcagcttgagagacagtttgccctcaattggcttattggtttgtacaattcttggctccttcaagcagggtcctgccatctgagcccactctgtgggattatgggatacctgtacttgccaggaagtcctggcctcaagctgattcatcactgggtagcacatgacgcccagatgagaggggggcatttttaacctcaatggcatgaaaatttcctgaaatcaaaaggacagagattgggagttcctggggagcagcagcagcagcaatgtcaaaagtaggatcaaccagagcttagaatattcctacaccaactttgcaagttgttcattgatatgtgggttgctggaagaaagtttccagcactgctgggtcagcatataaacaaggaaaaaagggtgtgttgatggcccatttcaaa

SEQ ID NO: 139441 - DNA, 1195 bp, Homo sapiens
atatgatcatctatgagagaatgagaatgacagatatctatctgttagtggatgagagggccggtcagattgcctagatttcagttccacctttgacagttattagcagacaaattgtttaaccttcctgttccttgtgtttgtcagttgtcatatgatgatagtaatacctagttgccttttaaggttttggtggggattaaatgacttaatctgtgattagaacaatgtctgacaggtagtagatgatctgtaaatgaaagccgtgatcattagcataagcagatactctgttttgctttaattgtatcacctctgttattgtctttattactatttaaccttttttatacatattaattatctttattgttatctaaacatttgtttgtcatcttcccaactcagtttttagctccttgaagacatatctcaaatttttttggttgaggggagggggaactctccattgtggtccagagtagctgcccactatatagttactgattgtgaactctttggaaacaagatttaaataatgatatatgctgagttaggagtatctcagaatgattggcttgttgtcatttcattatttcttctaaaaaaccatattattatttcagtactagttaatttcataggtattcattgaatgcttatggatagattgacaaatgaaattgttctgaatgtaaccatatgttgacatgaccattttatagattgttaatttctgtagccaacctcctgcctattatgggttgaattgtgtcccctaaaaagatatactgaagccctagtccctatttcctcagactggggtcttgtttgttactgcagttgtagttagttaagatgaggtcatgcagcactggagtagggtggactcctcatccagcatgactggggtccttatgaaagaggaaagcaccatgtgaaaacacagacacacagggagaaagccatgtgacaacaggcagagagattggagtggtgaagctgcaagccaaggaatgccaaggattgcagccaccaccagaagctagggagaggcaaggaagcattctcccctagaggctccagatggcacatggcctagctgacaccttgattttggactttgggcctccagaactgtgagagaatttatttctgttcttttaggccatccagtttgtgggacttctttaca

SEQ ID NO: 139442 - DNA, 1076 bp, Homo sapiens
tatattatttataaatatataaattatatatattatataaattatatattatatataaattaatatatattaaattaatatatatttaatatataaaatatatataaaatatatattaaatatatatattaaatatacaaaatatatataaatatatatcaaatatataaaatatatattaaatatatattaaatatatatatatatttgatatatatatatataatataaaatatatattaaattaaaatatatatattaaatatatgttaaatatataaaaatattttaaaaatatattaaatatatatattaaatatatatttcccatacctgatctggcagcaaatatatttttatatatggcagcaaatatatattttcatatatatatatgaaaatctggcacaaaaatacggttcttatatgcatgctaggaatgggagacgtttccaaagatgcttataaaagcactgtttataattgaaacctggaaacagctcaaatgatcactgggaggagaatggaaaaaccaagtgcaaagcagtggactgctatgcagctgtgaaaatgagtggaacacaactatatgcatcaacatttatgactctctcaacactatgtgagaaaagcaagtggcagaagaatatataatgattccatttacataagacttcagaaacatggaaaatcatattatttagggatgtatacatgtggaaaattttaaagatatgcaagggaattataaacctaaaaatcagccctagggaggtaggttggagtacctttaatgactgatgactaacttctccaaagtcatgaaagtttatgagggtgatgctacatttgtttcttcacggaatactgagtacccaaactgtgctttgtgctggtgccagaatggaaaacatggtccttggccttaggaagttctagaaatctaagagacgggacacaaaatatcaaggcataagtacagggtaagaaatgaaatacaatcgtcccttggtatttgcgggaaactggttccaggactcccgaggataccaaaatccttggaggcccaagtcctt

SEQ ID NO: 139443 - DNA, 1065 bp, Homo sapiens
tgtgtgtgtgtgtatgtgtgtgtggggggaggtcaggaaaagctttccatgttttgaagtaggtaaatgccaacaaagcatatgccaacgaagcccctgcttctgccttcaaatgagagtacctagaggaattgtttcaaatggcaggttatctccaaccttttctcctctcttcagttttctagatactgtgcacatccactctagagttccttttttcctccctcctccactactgattctgctcagaagaatcttcatcagtaatgcccaatgcctgggcttttctttggggtcctttagcccagacctgagaaggttcttggaaagtaaggagatgttttgatctggcacctttgttactatcatagttataactatttatacgtttctattcttcaacaattactgttttaacttttgctaaataagttactgtttacttataaatttaaaatgtactttttgtgaatagttctcacaggggaaaatagttcaataaaatgcagtttttttcattgagcagatcagctgggttcatgagttttggaattggcagatgcacgggaacttgatcttgttcctattttaaaactttgtttactggcaggtatttgactgttaaaaaatccattggtgagtttaatgatctgtttaaatgtgtgcagtattgctaggtagcctttgtacattaaaaacagataacctgatagtagttgacttttctaatagtttacttaccatatcactttcaatttatgaataatttctaaagttaccctgttccatggccacagctcatgccactaaagccaatcagctgtcttgaagatgtgccatttgtcgtgaggggaccaagaaatagggtgaagagatcagcccaaatccatcactagccactggaaaaaatgattcaaaatgcattctccactgagtctgaattacattatttttagccaaaggtctttgcaacatttaaagaaataggggtaggtatatcatcatgtttaaaatgaattgtaaatatcaaaattatacagagagtgagattttaaatgaaatact

SEQ ID NO: 139444 - DNA, 1159 bp, Homo sapiens
gtcttagtgaaataggaaacgcaataggtaatcacaatgattttcgggcattgtaataggattctggctaatggctgtgctgttattcagttaagcctctgtggaattgaagttttccttcctactcttcccaaaagatggctgaatatgaaaaaaagaaagctgctacagtgtatgtgtatctatagaacacacttaatgtttactttttatcactttcccgaaagctgttaactttaaagtgcttggaaatgtagtttaaaaattaatattattgaaaagcatgctagcattatttaatactagaagttgacacatctaattaatgttggtgccagattgtaacttttttgtttgaatttttgtgccagttttcccaaatgctaaatctctaatgctttttctttaaaaaacatatttctagtggcttgtattcctagttgcttaaaaacagtgtgtaaatgtaacgtcattacttctgatgcatctgttttgtttctagacgtctcgagatggagtcaatcgagatctcactgaggctgttcctcgacttccaggagaaacactaatcactggtaaggacctgctgacataagatttgcataacttgaggagaagtctggcaggatcaggtggcttcagtcccgcttactctttagcagtcaggcttagacaaataggctacctttgtttagaagcgttaacacagaactctctgcatccctttcttgattaaagagttctttcgagagcttcatgctcacaagggtagtgatattcttgtgtctgtaccaaagactgagaatgatttaggggaaaaaaatgtggattatctcttgaaagtctctcattggagccataagctctcatggtttaaggttttaagagcaaaatgatttccagtcaatgatgcatgctttaaaatgataaacttaaaggcttgaaggcttaatcattctcctctttgaaatataggagaacatattgctttaaaatatctttcattcgtcagaaaatggaagttagtatttaggtaatattttgatgttatttttcatgataaacgtatactaaaaggaagggatcaactttggaagggctagatcactacggcttaagaatatagaagcatctgacagcttctaagccaagtgctaat

SEQ ID NO: 139445 - DNA, 1114 bp, Homo sapiens
tgagaggccaaagtaggaggatcacttgaggccaggaattggagaccagcctgggcaacacagcaaaacttcatctttactaaaaattaaaaaacgagctgggtgcagtggcgcatacccatagtcccagctactcaggaggctgaggtgggaggattgcttgagcctgagaggttgaggctgcagtgagccatgattgtgccactgaactccagcttgggcaatagagcaagaccctatctcaaaaacaaaaaaagacagaataaactggaaagatttctactgctgacatttatttattaaaaacatgattatgtttctgtggttagagattggtagcctcatctctcagtctagtggttagtccgtgagactgtcccaggtgagttgccgtcctctggctgaagtagctcaaatagttacctttacaaccaccttagggtagcagcagcagtattctcattcacttctattgtcaccttgccccaggtagtgacagcattgtgggaaagctcagggaagcactgttagtgcctggaggtggtgtggccccactagttctcccactaccccaactcaacccagcacggtaatgtagaaacattgccagtgcttgctttcagccttttcagtaatttttaaaattgtagttattcttagctgaatagtttatattaaattagtgccatttgttgtgtatcttggtatctatttccattattttagggtactttttttatcttaatagacaaagaagttatttacatatgtcctttcaatggccccattaagggaagagtttacatcacaaattatcgtctttatttaagaagtttggaaacggtaagtagaatataagaccataaagatgaccctaactgttaaagataatgctaaattgtttctcttctactttgcaagattgactgtgggtcaaattaacatggggtatatttgcttctcaactcttaattttttgcttatgcaaaactcatttaacactaacacttgtatatgtaaggaacagggtcaattaaaaaaagtcttatccctcataatggtgggggaggggttagtaattgtaaccatttgctagtttggagaagttaggtgt

SEQ ID NO: 139446 - DNA, 1100 bp, Homo sapiens
ggtagacagtaatacacagtaaaagtgtattgagtgaacttgggaggaaatgggctcctaagttgttagtgctgctcagagggcaaaggcctagtcactgtggtttgaccacagtatggctcctgctacattgtggcatcttgaatactaacattgcttctggatttgagaaatcccatagctaccttttggccttgagggtactaaggaatttggctttgggttaatgttgtgactatagtagggcctactgtaggtaggtgataccctgtaatctggtagactaccatgagtaagactgctttcaggattccttccaggagcactttgtgtttaggtgctctagtgcatgagaaagataccttaaccctcgttcattcaggcattcatgtcttcattccagaaacattcactgagcaccatggtgaatttaatactgtgcaaggtgcataatactataccctgaggcctgcataacctcataggatatagagttgagtaattgtggtataatatgacaaagcctacagtggtatgcatagtgctgtgagaaggaagaagacgtacaagggaaaagacgattatgccagtgtagcaagtcatagaatgctttatagaggagatgatacttgaaccaactcttgaagaatggtaacaattttctggacaggaaggaaaaaggagcatatcaggtagagagttaccgtgtctatatggtacttttctgtatcgcatgtataacaatatggaaaagcaccatttgttatgaagatggttgaatgatcggttggagctggaacattgggggttgatggaggagtggggaacagaagaggatgaggctggaagaagagccagcagccttaagagtctcataagtcacagttaagcagtatgcaagttacacagacaatgacatatccaatgtgatttcaggaagagaactccagctgcagtgtgtgtgtgatgggttaggggcgggagagactgaagtcaggaagcccaactaggaagttattttagtttcctaggtaagtgataagggccttaatacagtcatagtggagatagaaaagaggggacagccatgagagatttgg

SEQ ID NO: 139447 - DNA, 1050 bp, Homo sapiens
ctttgacctcccctttcactttgtgtggactttgcctatggctcttggcactagcaacctggcattgtagttacttgagtccatgtgtcttatctcccagatagagctaggccctgaactccatgtgggcaactctgcttcttaacttcatgaaccctagggcccagtagagtttctgttacttagtgtatgagacagacagacagacagagacagagacagagagagagagagagaaagaaagaatgcattattttaggttatttaactcccctattttcatgtcaattactttaggtagttagaagtacaaggcatagacttttgagttagaatgggcctttgaaaatccttaaatatttaatgatatttagatactgatgactcaggtatccagaaagttcagctaatttgcctattcctggatcttgcagtttggcctgctgggttatctgaccttgaatgtgtcattcagggagaatgtagcaagtaaccttattagacggtgggtgcctttggtcagaagctggctggttctcctcagcgacctgttttctttttttctgtgtagggccagggctctttgagctatacagtttcctctgtacagagacaaagagtagcaaggtgttagctcacttttaattcttccacttttttcaaacatccttgcttccatgttgatgctagagtatcagacttatttagtgtctattctgtgtattttatgtataaatttgacatttaagaatacagttcacagacactcaaatgtcaatatggtatatctaagcataataacagactgatactgtgttttaaataactgcactgtatcgataagtaaatacatgaaaatatgctgcttatatacgtacactgttactgagtagtatttttctctttgggcatttaggtttcagtcatgtcatgaggtgtcttaccccgtgacattcctccttataggtacaaacagtaagatctgttagatgcttgctagagcatactgatccactatatttgaagagcacaattacatcttccaaatac

SEQ ID NO: 139448 - DNA, 1022 bp, Homo sapiens
agagtgagactcatctaaaaaaaaaaaaaaattaagtgtggctggtggtgtgtgcctgtggtctcagctacttggaaggctgaggtgggaggatcccttgagcctgggacgtcaaggctgcagtgagccactgtactccagcctgagcaacagagcaagaacttatctcttaaaaaaaaaaaaaaaggggggaaagaaaagaaaaactttgtagccccaaaaggtttttaaggaacaaaaaaccaaataacccttaaaaattttttttctttatttttcaaacttatctatcacaatatgaaagaaaagtttggattaaaaatggtgtagcccttcatgtctttgtccctgtaaatagatatttcatgttattgtagtcaccgtgtgtgttgtatgctgctgtttcccacttaaacttacttttccatgtaccataattattttaaaaactgtatacttgttccagcgagttgactataattttttctaccctgttatctacctctagctccattgaacatcttccttctgttaagtgatagccataagttcttagtagcgaaattattggatcaaagagtaggacaatttttatggcacttttaatgtgtgttttcaggcattgcctcgagtctcaaccctgccctatacttactaaacaagttattgaagctttgaaaaacttaggaaatggggatacttcacctatatcctggagcggttgtgaggataaaatgagatgatgcgtgcaaagcccctaatgtagtacctggcacagaagagaggtatttcctacatggcagctgctgtgatgatctcctggtgatgattgtgctattacttgactaacatgattccatcatgccagcagtcttctagaccacttgcacccagcgttggatagcaaatgatggagaagccttgctgtgcattaaggcccttctgctttgggaaatgcacgcatgccagagacaagcaccatttccagatgcgtggtctctagtgggggaatacatatgtgt

SEQ ID NO: 139449 - DNA, 1036 bp, Homo sapiens
tactttcttggttcagattttgctgtcccctttacctgcagtcccctcgtctcttgcttacccatcttccacacacttagccttcaacatcttaatctgtcctgtgtccttttccaggccatatgtgtgtgcccccagtgagagttcatcttaccgctcaattgttagtctttgcaagttcctctatcagagcacttatctcagtgtgccttatggaataattttgtcataactacctcctacctccccctaccactgcctgataaattatgagcttatcaaggcagggatcagcctttatttctctctctactgtcagcacagtgacatctgcatgggagttttgtaatgatggctttcttcttgaactcgggttagtagaaaggaaggaaaaatcactatatggaaacaaatgagatggatgtttctgagtattacaaatctaacaccaaaacctagaaatctctgttgctgttattggagtcatccacagagggcttgatttctcaagtctgtggtacttggccatatttttcatacctgtgctgagaatccctgcttcttgttttaggaagtcaataaagtaagaaactgccaaaaaaaaaaaaaaaaaagtcaactgaattgctcatatgaagttttggaaggtgacattatcttaggttttaatcactgaaagtcatccttaaaaaaagtttgccagtcaccaatacaatgcaagatacagattgaaacagatcagcccttgaccctgcttttggaatagcagtccctgatattcaagtccacatgtgcaactgtttcatcagtcaagttcatttcatgtcttgtgttgggtggtgtcaggatgcagtgggggcagtcaaggatttagtagtgtgtaggatgagtgatacctagtcccattgagggatgtgacagtcaaacagtagtgatgtgacaaatatgtttagccccaacataagatagtatacattcatttgtgcaagagaaacgcaaaggaaatccacgggggactcacaggaagaagagacca

SEQ ID NO: 139450 - DNA, 1539 bp, Homo sapiens
tgtgcctgatctgagtttttgtttgctaaaatttccattgttatgtttttttaattataaaagttctatttgattgtttttcagatctgtttggccattatttataatctcttcttctgtgctcagatttctcatcctctttttgacttccgaaagcacattaaatgtaatttataatatgcatctgatgattacaatacccgaagtctttgtggacttttctaccacaggtgtgtgtgtttgctggctcatggcactttgtttctgatgtgggtgtgtcttgtgattattgcctgcaaattcctcttccttggaagtttatctgtgggaatactctgagcatatgactgaaggcaattttaccaagagaggatttgtgtttctttctgccaggcatcttgaagcatgactggtttgggacgcttatgaattaaattctcaggttggatgtttttgggaccatccaagttttgtgagtttcgtccacatactacttaagggctgacttgtgactacaaatttctagtgggggatggtggcagggatttgtttcctcccttgcttagcaccaataatctagacaggaaggttctcttgaagtccccaggtggtcctttcccatgcatccttcccctgagtgtagcacttgggaggtttcctcattttggtttggccaggtcttcaggccctatctcctgtgccccaagaggccatgaaaaccagttctggaagtggcctgaaagtgaaagccagtgtgttcctcttgctgtctgcattcctgtttgcagttagtttttggcttctgagtaaaaaagtctctgttatatccagcatttttaggtgttttcagcagaagtcccattatggtataaagaccatcacatttgcagacacctctccctcttttttttgaaacctaactttccccatagcttctgagatctaagtcctctgcctctcacttcttttctggctcctctgcatccttctaccatctagacatgggttttctacaaaagtctgtccttgctctgaattatgccctgggcaaactcatgtccacgaacagtgcctttctaagcatggcttccaaatataaagcatggctttatatttccctgtagctgttatagaacttcaagcaacaccaaaagatctgtttaaaatgactctcatatgccccagaaacccactcctctgtgttcccagttactcttaatgatatcattgtcctcttgttcattcaaatttgaacattcgaaatcaaggccatcagaggttttcatttcttccttttcttgttttctttttttttttttgagacagggtcttgctctgtcacccagggtggagtgcagtggtgtgatcacagctcaccgcagcccgcaggtgcatgactctacacctggctaatttatttttcttttcttttagatggtgtctcactgtgttgcccaggctgacctcaaactcttgacttcaagaaatcctactgcctctgccccctaaagtgctgggattacaggcatgagccaccat

SEQ ID NO: 139451 - DNA, 1049 bp, Homo sapiens
aggttatatttaagaataatagttgaaagtgtcaacacattaataaagtgttaaagaatacattgtctggaagagaaagtaaatgacagctaaaaacctcaagacgtataacctattcacttcaggttttaacaattttgaaataggagctttaattaggcttgtaacaagttaccacttgtaggggattttatgctttttgataatgaggtacagatgaatgtgttttgttattgctttatttttgtttttgtaataatccaactttatgttactctgagagcctatattctcttaatctttaagaaaaaaagaaaatatatctgaaaagtaggtcctcgtactttcaagttcagaaaatggtggtattggctctttcagactgctcacttcaattgagccaagtagcttatggaaaacttagtttttaaataaaaacaccacataaacactacctagtaatgctttttgaaaaatgtttttctgtgtttgtaagctaatttatttgaatggtgaaaatattggtttaagcacccagtcttttctaccctaagctccaatttaatattagatgtgttgctatgtgcttcacgaggagaaatatttggctgttgtgcgattcataattcttcctgaaatatctggggtccaagcctggctcttagcatcaagagtaaactgggagttgtttttgtcaccaattctaatagacatgtttcgggttaaaggataccagttagttgactcattctggatattagtcagaatgtgaagtatcatcatagaagtgatctcatcagagagtccatctgatgtgtggttaccatggggacattgtctcagtctcatactaatgacaaaaaaaaattgatgttgcttctgttcaggttcttttataaaacatattaaggaagttaggtagataatttttgtttaggccatatagctttgattttctgataacaattttataaacttagaaattttcatgtaagatacaggaatactggaagcaaaaaaaagaaggtgctttaaccttagggattgaa

SEQ ID NO: 139452 - DNA, 1073 bp, Homo sapiens
cttcctgtgttagattctagaattgagactgttgggaaaatgatctgtagacagagttggtattatgagaaacatattgtaccagagacaatttcctttacctctcactttttgccaaagctgcttctatatgataacaaatccagtgcaagctacataattaaaataggatcaagctttcaatttcctttaagtgatataactatttttaggtaagcaattaatttatattggatgtggtgctaattaagaaaagactggtaattgtacttgtttctgagttatattattaaatgcatgtctctgggcacacacacgcagtgagattgcaagtgaacaagtattctattttagcacaatcagattcacttcttgataaccgtcagtgctttactgttttacagttttaattgtttgcttggagatttgctttcttgatagcttaaactttctgacttaaccataggtgctgtcatggattcatccagaaaataagacggtcattgtgcgttgcagtcagcctcttgtcggtatgagtgggaaacgaaataaagatgatgagaaatatctcgatgttatcagggagactaataaacaaatttctaaactcaccatttatgatgcaagacccagcgtaaatgcagtggccaacaaggtgagtggacttaatgatgtgctggacacttagcttacatatggagtgcagtgttttctgtgaatgtttttgccatgatatagaaacacgtgggtttaaattaatagttaagaaaaccagttctcttagacagaaagtagttttaatcacaaaacttaaacaaaattgaatatatcaaaatcaaatgcaaataaactttaggtaaataggcatgtctagactgtaatgaaattgggttttggccaggaccttggcaggaaaaagttagattctctttaaagccctttcagctgtggatgatcactcattgtgtacactattggggcatctgtaagaagctatgggaagctgtaattattaaaatactaaatttgcatgcttactcaaacactccctcccccatacccgtatatactca

SEQ ID NO: 139453 - DNA, 1008 bp, Homo sapiens
agaagtctgtctcaattgactttttgctgtaagcagaatatgctgaatgcacttaaaattgattagggtcatcatgaacatcagtgactgcatagtgttgccttcagaagctgctgcaaggtgtatggctgtttgcttgctctactaaatggccccagattgatgtgcattttacgttctatttctcctttttgttgtttttcttttccttctcctcccatcattgctgtcactttcaaatgctcacgaggggcctgccccaaattgctcactcccattccagctttcagatttattgtttctcctctgctgtaagcttaaatttcatcatatttaatacattgcttatcctgaggttatttgtctagcatcttcaattattcagaacataagacaagaaccagaaagcaaaacaagttcttgagcagctcagataggtgcagcagcttcctaatagaatctgtgatatctgtctggactaggatgtgtcagactgcatgcatgcagagctcaactcttcattatttgtgcacagatcttctgtcctacacatttaatcctgggccacctccccatccccatgcatgcttttaaaccagctatttgttactacggttgttttttggtccagagatgattttgaaattatatgtgaagcagtcagtaagttaaattgacaagtaaattaggaatcgtaagtgaaacactcaggaaattaaatctaactctaaatatcttcttggattgtccttaattttatatatctgtgtacctattatctttcatatatatttcagggtgaatatatatatatatatatatatatatagcaatattttcatgtacatatttagcctgaaatagatatgatatagcattacaatgaagtatttacaaagaatattttagaatattaaaatgcatgaaatggatacactaattaaagctcattccagcaacagaattcctgaaggcctttttaacactcaggaaacaagcttctatttc

SEQ ID NO: 139454 - DNA, 1811 bp, Homo sapiens
tgaagatgaaccaaagcctgccctggcaagttaatacttgtagttgctgcagtaggcggtagccatcttgtctcctcttgaaatcttctattctttcagagctcactatgtgcagtgctctctcattggtgtttgcatagcagagaaatagtcatggtttagtagaaaaagttcgagctttgaagccagacttagacttaaattccacttattacctatgtgacttaggggatagttaactagcgtctctgagtttctgttttctcattggcaaaatggggacagtaatacctatcttgcagcactgctgaagagagaaaattatgtaaagcaagagtcacagtacctgggatgtcataggagttcattaaacagtggctggcattagctattataatagagtgtggttcctttaatagtatgagacctaggtaatattatcccctattttacaggagaggatgttgaggctcagaaatgttaagtgccttgtcccagatcacatggcaaggagaagctgaagctgagctatctcagcctgggtctgtctccaaagcctgttgttttcctctaatgcatcacgtcctacgtgagtgctgttacagtgccagaggtgcctgctgctgcctcagtctggctgcctcccgccttccccctgaagagtactattagagatacaaaactaatggagaacgaggacctttcacaacctgcttttgcctttccagatccggaagaagagctattaattatagagcattttgaggatgatttttttccttaggaatacagattccccaggaaattgccagccttctgtctttttttcaactcaaagtatgactaatgtttttgagacttgttgttggctaggaagtcaagtcacatcaattattcatttaaattggagggtttggggttatttggaggacaaataactagaaatatttgtgtaagtttctgatgaaatagaaaactcaactgattgtttgtatttcatgttgtttcttaggcaacaggaggaggatatgaaagtgatgatgcatatcataacgccgaacttttcttcttagacattcataatattcatgttatgcgggaatctttaaaaaaagtgaaggacattgtttatcctaatgtagaagaatctcattggttgtccagtttggagtctactcattggttagaacatatcaaggcaagtatattttgtgaaaatatttgtgtatataaaaaagaatgtaattgtttagtggaatggacatatttttaaattccttaaaaaaatggacattgagagataaactttgtagtagaggaccacatttaacagttttatgttgctttataatttgcttacctaaattaaagatttcacatcatcactccagaatatatttagagtttgcaaagacatctctttccatctttcagtattaagtcgttcagtctttcatgcaggtttatttaggaatagccaatttattatctaaccattactggatatgacctctttggacctagataagaggtggttagttttgttttttttgttgttttttgtttttttttgttttttgaaactaatctcaaatgacttattttaaagaattggttttgtgttttattatgttcaatcctttatcctgataaaggcagcaataatcctccactttttaaaaagtacttgaagtgatctgagggaactaacacttttagaaaccatttagttctgtacacaaacaaaaagtcagctttaatgtataggtgaattattaagatatattctctagtcaaattttgttttccaa

SEQ ID NO: 139455 - DNA, 1040 bp, Homo sapiens
gtgtggcaaatgtcaaaacaggtaaggaatatgagggatgaaaatacattcaactcattgtttaaattaaacattttaatataatgattgggatttgaccccaaaataatacagggtagagctagagatgaagcaagactgggcatgtgtgaatacttgcagaagccaggtacatgagcgttcacctttttattcctgctactattgatatatctgggattttccctaataaagttttaaaaattaagtatttaactctgatgtctctactagtggaattgacaataccaagtcgtcgtttatatacattttacactgacccttatatatagctgtgtctgctatctcataatagcttaaataactaaactacactgtacctgcaggagaacccagaaaatcagcctgtttatctcattttcctctttattgctttatttaacacttaaagtgctcagacctatataaactgctaaaaaaagaacaactgtagtgtgtgtgcagattacagcctctgctgtccttcctagagccctacaatgtggcagcatttgtttacttctacagtgtatctttctaattttataaagtttcagtcccagtttttcatgctttgtttgcttgtttttgtttagttccctacagcttttgaattcaatgaacaatttttgattataattttggatcatctgtatagttgccgatttggtactttcttattcaactgtgaatctgctcgagaaagacaggtgagttaaaatgctattttttttgatacattaggcttgccaaaatgtatgtagtctaccatgaaatataaaaaatatgatagcttgtaagacactgtctttgacctcaaagagtaggaattacattaaaggtatgcattttgtgttatataaaggaatacctgaggctgggtaacttacaaagaaaagaggtttaattagctcacagttctgcaggctgtacaaggagcatagtgccggcatctgcttagtttctggtgagagcctcaggctgcttccactcatggcaga

SEQ ID NO: 139456 - DNA, 1091 bp, Homo sapiens
cctgagtaggtgggaccacaggtgcacaccaccacagctagctaatttttgtagttttagtagtgatggggttttgccatgttacctgggctggtctcgaactcctgagctcaagtgatccacccgcctcaccctcccaaagtgctgggattgcaggtgtgaaccactgcgcccagcctggcgatcagatttcaacatgaggtttggagagaacaaatattcaaactatgacagaggttcccccaaaagtaaaaatatagctaccatacgatccagcactcccactattgggtacatatctaaaggaaatgaaatcatcatgtcaaagaggttatctgcaatctcatgtatattgcagcagtattcacagtagccaagatatggactcaacctgtgtccatcaacagatgaataaagaaaacgtagtacctatatacagtagactactactcagccataaaaaatgaaatcctaccatttgcaacaacataagtaaatctggaggacattatgctaagcgaaataaaccaggcacagaaagacaaataccacatgatttcccttatgtgtggaatctaagaaaacttgaacctatagtaacagagagtagaagggtagttaccaggggctggggaaggggtaagggaaagaggaacatagtggtcaaaagatacaaaccttcagttataagtactaaagacctaatgtgcagtatggtaattatagttaataataatgtatatttgaaatttgctaaaataatagatctcaagtgttctcactgcaaaaaaaattggtaactatatgaggtgacagatgttaattagcttgattgaggtgattatttcataatgtatacatatatcaaaatatcacatcgtataccttaaatatatacagtttttatttgtcagttgtaaataatactgggggaaaaacacaattgtttctgggaaaagaggtgagagagagcactttttttcataaccttgtcaaactatttgactttttaaactatgtgcatatataaaaataaaaagagtaacatgcaaataaatacaatgtggtatatagattttggcatcaaaaag

SEQ ID NO: 139457 - DNA, 1053 bp, Homo sapiens
gattctacctttggtaattttaattcttgtatttttatttccctagctttgatgttttttttttttcttcctctctctagtttatggtcaaaattttgtaaacgcctgcaataaaaagcaatgaaaatgtgaatatctttatgagatggcaacactaggctgaaaagcttagacttcgtgtagtcagttatccagatgttttcaaagatatggatgttgacatgatgtagattaaacatctggatggttgattaaaataactgtgtccagatgcctactgtcaagtagacacagattaagatttcatagttccaacaaatggaaaagttttaaaagtcattgggatcttaggataatttttcttttcactgaattaaaaagagtataccacccatctgttcataaatgttttacctagctgggaatactcttctttggtcagtgaattgcatttaatggtacagtatcctgcgcccctgtcttcaggcagaaatagtggctctcaagctaggccattacctatgcaaatatcgataagtggctgccaagcactcactggcccatgaggctttttgagctattatgaggataatgtaaatgtgtgattcaatttgatgctgaactgtattgctacaggctgcaaaatggtttgtggatttatgtgtgtttttacttaggctctccactttctctctctgtctctctgtagaaggttacagaaaggactgtttctttatggtcactgataaacagtaataaagaaaaattcaaaaaccccttctatactaaagaaatcaatcgagttttatatccagttgccagtatgcgtcacttggaactctgggtgaattactacattagatggaaccccaggatcaagcaacaagtaagtgaagtagcactgttaaaagatagcaatgtcaactgcttgccttagataatgttatttggtatggattttttttaacagcatgaagaaaaatatcagactctaaaaacacacttattgttaaactcaaccttaatttaaattttttttaattactaaaccat

SEQ ID NO: 139458 - DNA, 1027 bp, Homo sapiens
tgcctatcttcttttccatgccaagctgagacatactttataattcatttcccaagtgagaagttgaggtataatattttgtcacttggcttgaagttttcatttcttgttgtctttgtattctatcacaaatggactcttctcttcttttacctgctctaagtggtttgtgtttgtctgtagcccaataacttctatatattttatacccattacttgactgaattatctttttatttctaacagtttttctgtttactcttttcagttttctgatgatacagtcatgccatctgcaaaaattactgttacccgatttctttttcttatctaattgcacatgctcattgtaatattcaagctgattctaaattctaatactcatatttcaaagggaggttttaaaaatagccacagttttggaggagaatatcaaggaagaacctgccctgctatatagcaagacttatttggaacagagtagagcccagaaacagacctgcgtcaatgtggagacttggaatagtaagaaggtggcaatgtaacacatccctatgagtggaatgttcagtaaatggtgctgggactggaaatgaaagttaacatgtcaaaacagaactcctcatgtttcccccaaaacctcctcctcctgccatcttccccatttcagttcgtggtagcgccagcctagtcgccctggtcaggaaccttagagtcatccttgacacctttctctcccacaccccatgtccaatcaatctgtcaggagagcttcttgggctctgccttcaaaacacagctagagtccaagcacttctcactgagctcccaccaccatgctggtgtgtgctgcctgccatctcccgtgtgtggcagcgataaccttctagctggaccccctgatgctacctttacttctttctactcttctcagcatggcagccaaagcagatcatgccactcgcctgctagaaactggccaggtagctgctcacctcacccagagtcaaggcgcaagtccttacaa

SEQ ID NO: 139459 - DNA, 1503 bp, Homo sapiens
agactgtcagtaggaggctattgtagtaagccaagtgagatggtggtccagagtggagcggaggaggggagaagtggtcagatactacatgtaatttgaagacctgcagggtagagccaatggggtttgctgaagattggttggttggtatgagagaagaatctgggagaattccaaaattttagcttgtgggaaaattgtgttgctgagatggagaagtctttctaaggtggagcagggttagaaaatagcaggctcttcgctctggacatatcaattttgagatgccaattatatgtcccagaatagatgtcaaagatatagttgatctatctgagcctggagttcagggttgtctgggctggagattcaaactggggagtcatgggcttatagatgaggcttaaattcatgaggcaggtggagttcacagaagaatgatggaggtctggaaaagggaattgggctaggaatagggctgggtggattttcaagatgcttaccaggtaagagtgacccgacatggtgagcattcagatgtgaggggggagtgccgggtggactccaaggcaaacctcagctttctagcgtgtgggggccggataactggctgtgctgcgccctgagttaggaaacacaggagcagagtaggttgcggggctgagcggctgatgctggtttagacaggttgaattggcagggtctctgggccagactagtggacaggtcttgtaggaacatcagcattgagatcaggagagtccaggttggagaaacagagctgggagcctccagcctgtaagtagttattgacaccaggagtatagagggcaattgcacagactacagagaagggatgggggaggaatcatggcctcctttctcagttctgtcagctcaacaagctcagattcacacttttctttgaagagtgacctctagaatggaacctggctctatgggtgggacttggccatgtccctgggactatggggccttcacttctcttctgaatactgtaattaataatgaggaagctgtggtcctgtaagaggatgtgtcttgccaaagatcatggagttagctggtgacagaagcaggactcatgtccaggcctcctgtctgctaacccactgtgcttcactgtgtgtaactacattggccaggatgcttctggttgcaggtgacagaaaccacagttcaatctagcttaaggcaaatgagatgccctggctcacagaactgctccagacaggaggagagatggccacaggcacagttgaggtcaggattgcaaacagtgttgtcgggactccccatctctctctccctctctcttttattttccctcactttttaatcgctgtgagttccttaagatggtaggggtggggtggggtggggagtggcctccagcagctctggatacagatccatgtatttcaggatccaaggggaaaagtctgggattggctggtcctaggtaactcacctacaagtggg

SEQ ID NO: 139460 - DNA, 1076 bp, Homo sapiens
cttcccaagacagcattctctggagcacctgtaaaaatgcagcttcccgggctccatcccagatttactgaatcagagtgtctgagggagggaaacaagtgtctcatatatttcttatgcatgataaaatctgaaaacctaggcttcctgagtttctgtctgttgaaattggtgatgggaccctgcatttctggtatattactaagaatctgaataattagcaactcagatattggagaataattattttattatttactcatatcataaattgtcagtcagcccagggtcagctcatctaaagtacagtaagaatatcgctggtatcacgtgacatgagtttagatggtatgtccatggacgtattttagtagctatgtaattattttcttgtgtattagaaaaatcagcacatcaggcttgtgatttagtagatgttatggcttagagcaggcaaagtattaaaaaggaatggattttaaatcaatataaagataaatacaaaattagtatgggcagttggcagatacagcaagccaaacttgttgaggtggtatgtgaaatggcaagtttggcaagcattgtcccagctgaaagagtagatagctattatactgaattgtgtggcagctaaattaataaatgcctgatttaataccgagtcatcctgaagattggcctgttaattaagactattacacaaaatgtaataaaatatttgttttgcttgtcccccctccactaccaactcaattgctttcatttttactaggctaacaaatggtaaaaaatttctcttgaatttgccagaaattttaagaacaaaatttgaatgtaatcttctgtagattagatgaaataatacagttacaaatggaaacatttttaggaactattagtagaagtgacatcattgatcacagcttccattgtttggaaagtaggactaggttatgaaaagagaacatgatggagtagtacaaacaatattggttagcttgtgaccttgtatagtctctgaggctcagtttccttttctggaaggataaaggggcttggattagattattcacctc

SEQ ID NO: 139461 - DNA, 1222 bp, Homo sapiens
tacttactgtgtttaaaatacatgtctataaactgcctttgtattttggcttgactttgccctttaccagttttctgtggtatgctttattttctgtgagcacattatgtgcctgttattttgtttctttgctatatgctgtctattgcttggttttgaaaagacagtacattctttgaaatccatgatgtttgtttgcttttcatttttctaccccaacacaaacacagaatagatactccattttaggctgtggatgctatagatggcctacatgttatttccttaactccaagggggaaaatgttgtgatttgcaaagtcatgaaaggtgtgtcgacttttacatgcttactgtctccttaaaaaagaaattctgtcctttcacctgtctgtttgcacgtgtttctctttctcctctttgccttttcttgtccatgcacctggtgctgtgcaggagattcaggaagaacacaatggctacccttctgaagctgaagctgatcaggtggcaagttctacgtgttcatctgtttgtagctacagatcgtgtatttagaagccatttcattctagacttctagataataagcaaagctttccagatgcctctaccacaatagtagtgccctcctgtccaaatttggtagattccatatgacattatttgcaaaaattggtttatccaacattttgtcaactagaaatttgtttgtctgtgtttcttggtttgcccagatagggttattgatggggttaatgaccctccatcacggtaggattctgcagtgcctttacatagacatagaggggacagatacatatgctaagggtgctccttgagggtgcacactttgctttcttcaaatatgcatgatctatgcccaacacagtacctggtaccatgtagatatttgtggaattggtacatatattaatcagaatacaaaattattcatagagtattcttgagtgcttactctgctcagtacctctagaccctctctggagtcttttaaagctgcagtactttccccaatgcttatgtgaaacaaagagaagagcagctccagggatgtgtggcatgccccaggtgctcagctgcaccattgtccaccatcatccagccccactctcctttggtgaccctggaagcaacttgaagagcccagtttgaaagccactgcttttggcatgcaaccattatataaactatccacctg

SEQ ID NO: 139462 - DNA, 1050 bp, Homo sapiens
gcatcattgtagccaggaaacctagtaaatcattagcaatttgcttggtgagtatgaaattactgcaaagtaaattgtcttgagacatgcctgacgaaaacaccctgctccgcagcagggattggaatactgttgcctgccagatgagagcacactctctcatggcctggattgggtgaacactgacaacttcactcttcatgtccctggtcatacgctttgtgcatgcatgtccgtgtgcacgagcacacacagacacacacacacacacatagctgggctgcagtagcaaagcctaggcctttccttagttgtgtactgtaccgagactgttctccggttattttcattagacttctggccttcccaaactttctcttaggctgggtcatttctccagttagctaagcacctatagctcatgttggtttcatttgtattagtttcatgctcagaaggtaacctttttctggccttatttgcaaattctagagacaccttttaatagctatctgtgtagtgattacagtatctttctgtcatgtcaagccatttctgtattaatgcttcctaactgtgaaatttaaatatgttgtaacaatttgctagaatatgcagcatggtgtcttgtgatgctaagcttttaagttgtctttgaaggggttgggtgcttattttgcacgcttctgtagccttatagtgacatcacagaacaccgaaattcttcacaggtatacggaaagtgagatttactcccgtttggtgtcctttttttttttttttttttttttttttttttttttgccaggctctaagggatggaaataagctggcacagatggaagaggctccacttttcccaggagaatcaattaaagccattggtaagtttagtgtgtacacttcgctttttgagatccataaaatgaaatggcacttaatttgcaagtggaggtgatgtatgtgctggagatccgccagaccaacttaattaggggacaaatggactagatctattcatcctcattagtgtcatcatgacctaagaga

SEQ ID NO: 139463 - DNA, 1051 bp, Homo sapiens
tgattaatttatcacccagggaaaatgttaactacctaggaaaaatgacagaatataacttcttatgaggccctttacttaaaacctcattaagtagcaaatcagaattttgttttaaaaaattgaaatttattagaagactatgcatctctctatattgaaagtcataattgatataatcctataaaatacaaaattcctggaaaactggaatcacaaatatatatttggaaaactcgtgttaagttttatggaagcacaagtctatggcagtagttgctactttggcctttttctttcagtgaaagatgtcatgtatatctgcccatttatgggagcagtgagtggaaccctgacagtgacggactttaagctgtacttcaaaaatgtcgagagggtgagttttttaaagtgtgttttattttaaaagaaacacttttaaaagaacactaaaagaagaaagtaaaaagtcccctgaaatcccattaccctgagataaccacaggttggattttgagatgcacacatttgcaaacagatgtttgtatcttgaaaacaaaggctgttaaagtaccgcttaaacctggaggggaaattccattgttgtctcaatatatatttcacaaggaatgctgtcaatcagacttcaatttagctgggacaaagaggaaatgcgaagtaaacaaacatgttttgtaacccagcaaagacttaaaatatgaaaactgttgactgacactaataggcattgatcttaatttttgaacctaggacccgcattttatccttgatgttccccttggagtgatcagcagagtggagaagattggagcacagagccatggagacaattcctgtggtatagagatagtgtgcaaggtataatagaaacgccaagtgaaaactaaaagagggcaatcagctctgaactttttctccctcagtctcttcatggtctttggacagtagaataatttgtactgctagtaactcaaatgttttcgggatagcaacctcttcaaatctcatatcgaatttaaactattatgta

SEQ ID NO: 139464 - DNA, 1108 bp, Homo sapiens
ttcttctaataatttaagtagaaatgtgtgtgataactttaatcacgaagtcatgtaggacccactcctaattgatgtattttattcccagtgacttgactttggtaatgtttaccaaaaaccctacctgaagtaccagaaaagagatcctgcctgcaggatcatcagcgccccttccaaattttgggttaggattccttacaatctatttattttgattcaatctctgaagatagctccctctggttggtcctagactgcgttcaaaaccattttttttttttccaaagaaccctttactcttccagatcatgaatctgttggcttactaaactcactttagtcactccctgacaactgtccttctcaggcagggttccccatatggaacaatggcaagcagaggggtgacttgatcggttctgcaattttgaaacatgtcgtcccctttctcatgacgcttgagtatcttcccattatccttagactaaaagaaaaactctccttacaagactgctctgcctgacccactttcctctgcagcttggtctcgaactgccctcctctcattctggccatcccagtcacatgggctttcctttggtggttcatacttgacacacccacccacacacacacacacacacacacacacatcccagaatctttgcatgtgctctttccttagcttgtaagcaatcttaaatagcaagtcagctcagtcagccaccaaggtgtatgtgtgtagccatgtagcttagagggagggcatgtcaggaaattatgttgcttaggcaggcatcctggggctcttttactaagatatttttatggctggggtgagcatttgctaacaactgctttaaatgttctctaacctagattactaaggtaatgctcccagccttctcagatcatgcctaagagctttacaaggtgtggggtttattttttaacaggtgatatacaattcaaaagatacaaaagctgtgtatagtaaaaaatcagtctccttccacccaccaccctgccaccctgttccactcatttcaggcacccactgtggccgatttctaatgtaaccctccacagatagcctatgcacatg

SEQ ID NO: 139465 - DNA, 1442 bp, Homo sapiens
ggaaaacactcctgaggtcgtaagggtggcagggccaactcagagggtccagaggagaaaagcatttgcagtggaagctttgtggaacaaaatagaaagccatctaggaaagaagaggcaagtgatgactagcctggtctgtggtagagggcaaaggatccagtgaggagtggccaagcagcggcctggggcagcggggcgcacccagcagatggagcatggagctaaggccaccagtgagggagctttccagctggcaggccggggtactatagtgacgtatccttgaggttccagggccaggcagctgaaaaggaacatgagcagttcagactgccccatggctagtggagtgtggagacgatctagagatcatgaagaccctaggtgagagggatgagggagcaggaggatggagaggaaggcagatttctgtatcattggctgacagagcaatgctattaaacaatgccctgggtacacgctcctgatggactgcagttaaactctgagagtattcaagtcaaaagaaaaatctcaggcctggcgcagtggtgcacacccataatcccagcactttgggaggccgaggcgggcggatcacttgaggtcaggagtttgagaccagccaggccaacatggtgaaatcccgtctctactaaaaatacaaaaattagccaggcatggtgctgtacacctgtaatcccagctacttgggaggccagagcaggagaatcacttgagcctgggaggcaggggttgcagtgagccaagctcatgccactgcactccagcctgggtgacgagcaagactccgtctcaaaaaataaataaataaaaaagaaaaaagtctcagcagacagttatctgtccatggaggtacaggctgcctctatctgtcttcttcaccacccagaaccaaccatgccctggccacccatgtggagactgggggtgcggggcaggactgaatccaaaccacgacacagtggaggatgtggggagcccttcaggaacccgcagccagagctcagccactgaacacaaagagaggacacaggcttggcggactggcccctgtagtgcaccattctctaattttgttcaatctcagaaaatattacagtgaaaaagtgtggtggggaggggcaaactctcccccttcttcaaaggggcacctgttctgtgattcaagcacctgccctcctactgctggactaacagggtctatacactgtagccctgatgcatcttccacacgcctttctaccacctctacgtggaaacagggaaaagggctgccaccccaacccccatatctgcaggtaaagtagtttataagaagaagggccaagcactggagcacatagcattttatgtacctcatcagtacgagacagaagtgctaagactttttaactgtaacccagcaaacatcatca

SEQ ID NO: 139466 - DNA, 1623 bp, Homo sapiens
ccagaatctcaaggagctgctggccgtcagggcggagctgcagaagcgtgtggagggcctacagcgggaggtggccacgcgcgccgtctcatcctcatctgagcggggctcctcgccctcccactccgccacctccgtccacacctcggtctgatgggcgaggtcagcctgctgctccactgtctcccggtggctcaggaaagggacctggcgatcactgttatggctgtagcttgtgatcttgtcttttaggattaggcccagggaccatttgtgtggctaggtgacagctcccactgttggcaaccgttaccctcctgtcagcggtttcacaggggagccgtctgtcacgcccaccctgtgaagcaacttctggcattcaggcagcttgggagaaactaagtgaacggaatgcagtactgaggttcaagaaagctgtacgccatttctttccaacttaaatccttcagtaacaacaaacaccactcacttcaagatgcattgccagccccgtggcttccctcagctcttggccacaacttgaaaactgtcttgaatgaagtacttggggagaagacaggccactgccctctgttccacagttttcttcatgcacggggtcctcctgttaacaattactgttgtgtacatataaggtatttttagagaagagaaacaggcctttattttcctatgtccttttttacgtttagaatagtcacccgaggggggatcagctcaactgtactgtgggagaaattcttttccaacaaacctcatgctcgtttttctgtggtgcaatttcaagggcaacgtgttctgtcctcacctcactctggtactcgcctcttggggcggctcagcccattcatggggatggcaccaagcggccatgctcagtcttccagccccgctgagggtaaaccgaggcctctggcagctgtgcacaggtgctggcctctggctccttcaaggagcactgcctgtcactcgctcctgggctgtctagccatgtctcccacccccactttaccgcagccagctgctgggatcaaagcaagtctgttcttatgttatttgcctgtatgaaatcatttctcattttatcacaattccttcaactcagcttactcgcgtggctgcctgttcatatttgaaagcagccaccgtgctgtggctttggtttggaaaagcatagcacgcacttcccttggttttcccttcccagagccgaccgcagctggtcagccctctcttcccgctcctgaacctttacttactgactttgagctctgtgactccgtcggttctcgcaggaattaactaacttaccaattggttcaatccacttgagcgccatagctctgagctcctctgtgtgacatgccacagatgactattgcacacctgggtcctgccccagcaggccatgcccctcccatgtgccgtgcctgttgctgcagctgcccccccaccccgccactggctgcaggaattcagcctttagaggcagaggcagctgcagcggcccctgaggtcaaaccccagtgtgactgcatagcagtgttagctggttggtttcaaactactggattccaggcaaaggcctacagattgacctta

SEQ ID NO: 139467 - DNA, 1121 bp, Homo sapiens
tgctgaaatgccctgaactgaactgtcgtcttctcaatttgaagccaacatgcgagctgatgagaaggacatacttcatcccaaacgggccactctccatgaggctgcaacaagtgacgaggtgcagggctcctttctcacccagctttctggttgaaaaacaactgcgcgttaactggaacctccactggttaccagcctgcttggaaggcggcagagcagtcgacttgggatttgtgagcctgggactttttgctgcttccaggccccggactgcgcaacccatgtagcccgggagcggccccgcagcactctgctcctgcctctgccctctctaaccccaggacattggtcgctccacatcccctggccttagctgcttgtacggtgaggagtcacccttggaagtcctgacactgagccagtcactgaggggtaaatgcaagaattctaagcttctcgagaaataccttcagctgggggcggggcggggggagggggaggagggcagctctgcatcataaattacttactttagggaaaagtggcaacacttgaccaagggcgtgccttaacaccatcagaagacaagaatctgctcggtgccattttatttaatgcaaacactagacagtttacaagtcacacctggacacaagcacgtgaacagatgtacagggaattctggaattttgagatcagtccccatttcttcctcagggccctggcactgaaccccagcccctgtcccagagcctcccctctgggtcccaccccagaagccacgcacacctccttccgcccagctttatctttccttgagctgtgacttcacccagcatgtgctcagagttgttacaaattttctctgccaaattaagctgatagagattggccactttcaaccagtcctttcagtccactgtgtctcccctctcgcttgggacaggcccatgctggccagtgcaaccttcagatagacacatggtgaccagagcccgccaggcttctgcaggtggcagtgtcgagcaagtgtaagatgtctgtgggaaggagaagctcctgaaatgaacgttctgcaaacagaaggctgaggggtcttccaggcatgtccagtcact

SEQ ID NO: 139468 - DNA, 1794 bp, Homo sapiens
ggctgctgccaaggggagctctttagttttacatgatgaccttgggtgtgggaaaaggaaaagatggcgggaagctggggggtgggacagggacgatgacatgccgcagctgcatttttatttggaaactttggagaaagtgttctcggctggacctgcattctgggttacagatgagcacgactagccctttttatacaccctccccctttagatagtgacgaagtgatgaattgaactaatagtacgggggtacctgctcactttccagatctcccgtgttgtaaagccgtttttttagtaagccaaaacacatcaacaatagtgacaatttcagatgtcccctacgtatagttctcctgctttggtcttgtgttcagcagtggtaagagttgttgtttttaattgtgttaacagttagcagatgaccagatagtcttaagtcatagatttcaagcttctatcacccccaccaaatgtgtcctctctctacccttcccactttgtgattgtagtttccaaaacatagcagttctgtaaacgtaacactgagtaccctacttgggtcggctccatttggagcacttgatcgcttttgagaagtaactcgcaaaccagcgcgcttcgtgctggtcaaaagttaaatgacaagcgacaatgaagctgatttctttcctactctgccttctgccactggtgtccggcattgggggaaggggacttcctaacagcaagtgtagttttagttttgctctgcctttggtacgtcttgtacttcttgtcaattcctccttgcttttcctcattgtatttctttgtttctcttttatcacagtcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaaggtatttttctttggtacccttcaaactagtcttagttgggtttcttactttggggttacttaccttcagattttctcccagatagctgcttgcttcctcttttacttttacttagaatcatttttgcttgtcttaagaattttgtgtgtgtgcttttatttttttaaggccctgcacaggtttcaggcctttacctacccccttttgcaagtggttctagcaactgctagtttaatcacaagaaactgaataggtatgtgttcactgcatcgagggatttaacgagtcctgttctttgcagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtaagtgactataggattcaagataacaattaataccttttcttctgcttggaggatttggttttttggtcgtcctgtatttcatttcaaaatgaaatattttttaaaagatacttaaaagatggcaatacctctgcaaaccattctgtacttgggctttacgatgcagtgccagcgttgtctgtggttaaggctgaagtgtttgtgggctgtgcttgcacattcacagtggttgtctgttggcctttccattgtgaaggaggcactctagttttggttgtcagggtccttgaagtatgttctttatgcctttcctagtaattgaaagactgggacagcaccatatatatatgcgcgtatata

SEQ ID NO: 139469 - DNA, 1026 bp, Homo sapiens
aaatatataaaggactattacaactcagcaataaaaagacaacccaatttaaaaaatgagcaaaagatcttaacagacatttctccaaagaagatgtataaatggccaataaacacatgaaaaatcctcagcatcattagtcatcaagaaatttaaatcaagactataataggatactacttaacacccactaggatggttataataatgataaaaaagggagctctttcctttcgctgctgcgactacagccatgagtatgctcaggcttcagaagaggctcgcctctagtgtccttcgctgtggcaagaagaaggtgtggttggaccccaataagaccaatgaaatcgccaatgccaattcccatcagcagatctggaagctgatcaaagatgggctgatcatccgcaagcctgtgacggtccattcccgggctcgatgccagaaaaacaccttggcccactggaagggcaggcacataggcatagataagtgaaagggtacagccaatgcccgaatgccagagaaggtcacgtggatgaagagaatgaggattctgcacctgctgctcagaagatactgtgaatctaagaagattgatcgccacatgtatcacagcctgtacctgaaggtgcaggggaatgtgttcacaaacaagccgattctcatggaacacagccacaagctgaaggcagacaaggctcacaagaagctcctggctgaccaggctgaggcccgcaggcctaagaccaaggaagcacggaagcgcagtgaagagcgcctccaggccaagaaggaggagatcatcaagactttgttcaaggaggaagacaccaagaaataaaagctcgccttttgtctgtacatactggcctccgtgaatacatagatcagccattaaaataaaacaagcctttatctgcttgccaaaaaaaaaaaaaaaagataaaaaaggaaaataactagtattggtgaggacgtagagaaattacagtcctggtacattgcaggtgggaatgtaaaatg

SEQ ID NO: 139470 - DNA, 1033 bp, Homo sapiens
gtttttctctaagatggtggcagcatgaccctgtctcattgtgaaggctcctggcagggattttgtgctcactgctgtctgtcttatgttcgcttctttctcagagcatttctttaaaagaattctggaattataaaaggtcataatccagctggccttcccctgcaccttaaatgtgtagatttctgtacttaaaccacttattcttctctgtctttcccctttctccctccctcgatatgtttttcaggcaacatcttcgtggtcagtctctctgtggccgatatgctggtggccatctacccataccctttgatgctgcatgccatgtccattgggggctgggatctgagccagttacagtgccagatggtcgggttcatcacagggctgagtgtggtcggctccatcttcaacatcgtggcaatcgctatcaaccgttactgctacatctgccacagcctccagtacgaacggatcttcagtgtgcgcaatacctgcatctacctggtcatcacctggatcatgaccgtcctggctgtcctgcccaacatgtacattggcaccatcgagtacgatcctcgcacctacacctgcatcttcaactatctgaacaaccctgtcttcactgttaccatcgtctgcatccacttcgtcctccctctcctcatcgtgggtttctgctacgtgaggatctggaccaaagtgctggcggcccgtgaccctgcagggcagaatcctgacaaccaacttgctgaggttcgcaattttctaaccatgtttgtgatcttcctcctctttgcagtgtgctggtgccctatcaacgtgctcactgtcttggtggctgtcagtccgaaggagatggcaggcaagatccccaactggctttatcttgcagcctacttcatagcctacttcaacagctgcctcaacgctgtgatctacgggctcctcaatgagaatttccgaagagaatactggaccatcttccatgctatgcggcaccctatcatattcttctctggcctcatca

SEQ ID NO: 139471 - DNA, 1068 bp, Homo sapiens
gataaatattacacataatctatgaatagcttaatcctttatatattccttaaaataggaattcctcgacatcactcctggccacactttccttgcctgtgttgttgctatgtgtatttgaaagtaatatctgcattccttttaagatgttctgtaagtcatatttgtcagttatacagagtagtcttccttttccccacgttcagtgtaatctcactgaacagtaataatagcaatagctaacaacatctgcacagcaccttacagtttgcaaagaacgttcacacattctcatttgagttttgcatagtgaacctgttacgagatgtctcttgacgtcgatgctaaaagtgttagaatctttacatcactagagtcattgaatatgctgtagtattgaatagtgccctgactagggggaggatttggatgtgctgcatttcaagccgtgtataatcatcaaaatggggggcttgagttctttagctacttgaatccgatttacttctgttaagtgatgcttttctaaccgttttctggatggattttgtattcactatattgtagcttgtaatttgtataaatgtaccatctgatgtcattaaaaaaagtgtttgtagtgctactttgctgtgtcctgattcaattaatgttttattaaccgctgtgtttttaaaaatttgtttgcctgcttctcattttataacatgtagaatatgtacagagctcactttaaaaaatttgttcgttggcctctgtttgtgctatgtagattatatagagagctgtcaaggataagtttttatgcagtaaatgtcaaccagaaatgctcaaactgattgggagtgtgggggaggggtgttgagctgtaaagggctggttatacttcgtctggggtgggcttcaaatgcccctaaaggagagttgagaaatgtggaaatagataattcctgacgacgtccacatgccaccccctcatgaccaatgtcctgtgtcctctgtcctctaatcacccgttgattgcactccagctccttcctgtgcttctgaggactccagctaattctt

SEQ ID NO: 139472 - DNA, 1023 bp, Homo sapiens
atccattgtacagggcagacccagtggacctggagttctcggtggatcaggtggactcagtggaccaggagggcccaatggaccagcaggacccagagaacccagttgccccgttggaccaggcaggcctgatggatccagtggatccagaggactcagtggacctgggggctgctggcgcaagtgctcaggtactctgaaagtctcgcttcactcgcttcacgtttgtctggatagctaaccttgcaaagcccaaattttcactcttgtgaccagtttcacttcacagaaagtatgtttgttactttttcaaaactatatcactatttctgttatactggattttcagatgccgttgagaactcaatggaccctcacaaacagggagattggaggttctctaagtaagaccaaatccctgtgctcttcttaatatgaaatcccatggacactttgtacttgaggaaaagtttgagccaaataagaagcttagctgctaagaaaaggtggtatttttaagagccctgcttttaatcacctgtgagagcatgctaaccatctagagggaagacaactttctggccttcccataccaaccctctccctgcaccacaagctaggttttcccagtggaatttttattaggttagaacatgcatttcagagtcgttagatatacccaaccttgaaacatcagtaccaatgtacagtccacggccaaatcaaaatggttggattaactactgtgtagttcctctaccctgaaatgtgtgtacataaccacagatttcgatgatcatcttttatattagacaggattattaaaatcaggattagaagccaagctaatgagttgatggtcagttacctggaattgtgtgcgttcatcactgagcctaagattgagtgactccggttcaaaaggatcctcatccagtgaaaataattaagggctagaacacaattgtttgagtttggccccagcagtgtggccttggcaaattactgagcctcagtttctcc

SEQ ID NO: 139473 - DNA, 1083 bp, Homo sapiens
ttccttccttccttcctccctccctcccttccttcctccctccctccctctctccctccctctctccctctctccctctctttctctctttctctctttctttctttctggctttgtaacccaggctggagtgcagtggcgcaatctcagctcacttcaatctccgcctctctggttcaagcgattcccctgtctcagcctccagagtagctgggactacaggcatgcaccgcagcatgcctaactaatttttgtatttgtagtagagatggggtttcaccattttttggtcaagccagtcccaaactcctgacctgaggtgatccgcccgcctcagcctcccaaagtgttgggattataggcatgagccaccgcgaccagcctaaattattgatttatatcctacctgtttgccaaaaggattaggtggcatattataaatgcacaataggacactggaaacataaatagaaagctgtataccacatcgcaggacagaagcatatgtgcttaacagctgggcttccagggtgcctgtgcttgactggcaatagtgacgctgaacttcctggcagcctaggcaaaaaggagggctcaatggattccacagttcacgtgtcttgcatccagttagtcatcaaaccagagcttctgcttggggaggggagcagtggggtgattgctcccagatgtggacagctcagcaagggctctagaatgtgtgtatgagtgggcgtgtgtattgtggggagggacagagggagcagtgtgctgtgaccatggtttaagtactggctggatagctccttagcaggagaaaggctttctgacaatagctcacattaggggcaactcttgtagttagcgtctcagtgtcgggcatctaaattcatgtcttggcactctactgccatgggctttaatgcaaagagagaagagaggcctggttccagaagattccaggtatcttgcctctttgtctggtgaagatgaacacagcgggtcacctgggtttgggccttctgattatgcctgggaatatgaagaatgcagcattgttgtgcatggaggatgagaccctgt

SEQ ID NO: 139474 - DNA, 1940 bp, Homo sapiens
tggtgtcttgcctgctcactcggccttgtttccctgcataattatgcttcagttgctgggctgggcctggtttgaaggagcccctgggcatctccccattccaggcctcagtagggctctctcctcagtgtttctggaggccaaggatgcccattcggtcctgaaacgattccctcgtgccaatgagttcctggaggagctgcgccagggcaccatcgagcgagagtgcatggaggagatctgcagctacgaggaggtcaaggaagtgtttgagaacaaagagaaaacggcatgtaccaccctggggctggttctgggagtaggagtagcctcaggaatagcaagaacaggccctggtaatgcagaccaatcagaagcaaggaaagacacccagcctaaggcatagccactagggccatcacggagcagataaagtacgtacagtcccattgcctgactcttttggggtcctcctcacttgggagcattgtcctttgcccttggtacattctgctgcctctctggtaactctgtgagacaagtcagatggggaagggtaggaagcaccagagttactgaaggcctctgagcccacctggagcttgagcttctcttaagtaccactttttcttttgcagatggagttctggaaagggtacccaaatgcagtctactctgtccgagacccctcgcagagctcagatgccatgtatgtggtggtaccccttctgggggtggcactgctgattgtcatcgccttgttcatcatctggaggtgccagctgcagaaagcgacccgtcaccacccctcctatgctcagaaccggtacctagccagtcgcgccgggcacaccctcccccgggtcatggtgtaccggggtactgtgcatagccaaggggagccttctgggcaccgagaggcagcgaacagcccccaggtggtgctggggcccagtcgggggggcaggaccacagtccggctagagagcaccctctacctccctgagctctctctctccagactgtccagcaccacccctcccccctcctacgaggaggtgactgcgccccaagagagcagcagtgaggaggccagcgtgtcttacagtgacccacccccaaagtacgaggagatagtggccgccaaccctggcgctgacaagtagtgggacgtttgtgccctgtcctggatgaacgcctctttccgaggtctcctattttctttttaactttttaaagactgtgccaccacaaaacagccttagcctccttgttgccaaataattccctaactgtggagttttaggaagtcagttgtcagagacaggtggggagggtgggggtagggaccacgcatgagtcgaagcccccgggaagagccaaaggccaaagtgcccaactctttgggatgacccccaagcctccaacatcctgtctttccatcaggaactggcttctcttatgccaaaggaataaccccattgagttgattgtggccagaatgtccacaggcctggcctgggggctgtgggactggctggaggcctgcctgtgtctagagctctgggcctcaggggtaagggaaggaagccagcctttcagcaccccttaccctccacagttctgtgatttctgtccttgcttacatttggaggacagggacaaggactgagcaaaaacaaaatgaaaaaatcatgacaaataaataattaacacaatagaacaaaactctagcacccgggccgttcataggaggccaagggaaatttatcacatggatctgtgatgtccgcctcccctaaaacctgtccccacactcctggaaggaggacagggtgtgtgaaggatgagggccagagggctgggtggcagagtttcctcttccacattgaccaaggggcccacgtggactctgccattcagtttctagtgtgcttgtc

SEQ ID NO: 139475 - DNA, 1025 bp, Homo sapiens
gcccgctgcctttggcatctgagttgcagctgggtggtaatgggagagagcaggaagaggcccaaggcctggcccatggagggcaacatgtgtccttcaggggctgaggacaggccgtgggaagagtcacaggaggttgcttaaggcctgtgatgttcggttcagatgcttcatggtgttctgccaggtggggttgcaccacggtctctgggatggtttctgcagcacattgtagaaaaaagactgtacagcacacagcaggcatcactccttgcgatgcacacttggattttatgaatgccctgtacatatcttttcaaactctgtgtttgtatggaggtggatttgatacaatgctgactctttcgtggctacatttttgctgtttttggacttctatgtgtgtgtgtgtgtgtgtgtgtgtgtgtatctatgtgtgcacgttgccttttctcattgcttatctgaaacaatagccggtgtgcagctatatttgtaccaggagggatccggtctgaaaagaggaatgtcacctcccctcgcagggctgagtagcctgatgacagggccctgagcaaggaaacgtggcattaactatattggacacccaacccccaaagttgtcactgtttgcctccttgaaaaaggctttggaagaagacaaagcagctccattctgcaggtctccaccctatgcaacccccgctcacacgcccttttggcatggtgcccctggcccaggcttctgttctgtgggtgtcagcagctgaaagaaatctgagtactcctgggcatggttttttttttttttttttttttttttttttttttttttttttttttttttttttttgtgtgtgtgtgtgtgtgtgtgtgtgtgtgtgtgtgtgtgtatggaaagatgtgtgactattgactttgggtatcgcgggactagttaattagatgtttttcatttttcaaaaagaaaaggttttaaaaattttcttgaaatgtgactgtcacttgttttcaaccaaaaactt

SEQ ID NO: 139476 - DNA, 1040 bp, Homo sapiens
cttaagacaattcacagtagctgtgattctggctacataaaaatatttgaaatattcttccctttagtcaatgttcagggtcttttgtgtaagagaaatccagtttaaaatgagtacccttttcaaagaaaaggctcaagatattaaggatcccttcaccgtgccttcagctttgcagttcagcacttctcgtatgtacagggtgatctcttgttctctctccatcacagggatgttggatattgcagcctttcactctactccgttatttatcctgtgaataacatagtttgtgaactagactgcaatttaaactaatacacatgatgtatctttctaaatattctgtaaagcagatgcttcgctgtcagactggccgctccatcattcgcctccaaatattcaaacgtgggagcttttcctttcagactgtgggcagcgagtctctctctagcaagaatttatctgacaaacatacccaaatagcacaccctctcaagctcaatgcctcaacagttgtttcactgtactgatatctgactgctgaacagtgcctgcccttcacccacccccagcccgagcattaacacagatcttcaggattgggacaaatcccccagctgcttttgcctctcaatccatctcccctcatcgataccaatttcccaggcctgaacacatctgttattttgctctgacattgtgaatttgtgacagtggaaaccctgatatgtgcaactgagcttatagaaataattactgtgaaatggattaattttgataccactttaaactgtgcttgtattcatgtgttgacccttgtcagctgggaaatctgtacattcagtatatgtcagcatttcattggagcctgggggcaacagacaaacttgcttctgatttctctctctctctctttctttttataattgttgaatttggctgttacattttgtctccttctttacaagaaaacaataataataaagagcaaatggcatccacttgaatcctgtcgtcatccatcttggatccctgct

SEQ ID NO: 139477 - DNA, 1042 bp, Homo sapiens
tattcagagctgtagtctttaccctagtgataagcgaaggccaccaaggggtgccttaaggagcaagcgggcatggccaggcatgctctgccagccatgtggaaaacaggctgcaggagccgaagaataagagaagtcagggaggtcaggttattgccatcgcccaggcaagagacagcgctgggatggatgaggctgatgacggaagagacagagagagatagactgttgagaaggtttttactcaaactttgatgggcacaagactatctgattgcttagaatgtagatctccagaccccaccctcagagtctgataccttgagtccagggttgggccagccatgtgcattgtgaccaaatcactcagttgattcttctgcaggggatctttgggtcacattggaagaaacactgaattctctattcaggaggcagaaccatgcatggtgactgattgcgttgggaaggggtagtgaataatcccagaggactttcaggtttaggggctcagacagtagagtagatggtagggccattccctggaaagggtcacagttgaggaagagcaggtttaggggagcaaaagaccacaggtttgagttgacgtgttgcatgtgtggtgtatagcgcatttgagtgtagttgaggagggaggcctaggctgcaacaggagagatcagaattgcttgaggtcccagaaagacaacaagtggtcttgagtgtggacctaatggcccaggagggaggccagacaggtgggaagaaaagcactggcatatggagccctgaaaaccgaaggactagagtgtttctagaaggagacagtggacaatgatgtgaaatgctttcaagaagccaaggaagatgacagccaaagtgaactcattgtatggagccatcagggggtcatcggtgacctcggcaaggggtgatttcagttccatggtgactgaagaagccagactagaatgagcagtgggatgcctggaaggtaacaagtggagacagtgcatatgatggaggcaacactttccaggag

SEQ ID NO: 139478 - DNA, 1151 bp, Homo sapiens
cctcagcttttcccggataggtggggacccatcatcaaaagtgacagagaagataaggcccaggggctttcaagtcactagtggttccgtttagtagatgattgtgcattgtttcaaaatggtgccctagtgactacaaagccccagagccagcatcatcatcaaagcaatgacagtaggtaagcaccagacctccttgggagtgaggaggattcttgaggagaaaagaggtcttctttctcctctgctggagactagttgatctggagacgtggttccttcaatgtcagagttatctttgggactggtctcaaactcttccagttgggccctggggcaggtctctccatctggagcatacttacgtgctcggcgattaagggttcagaatgcagtggtagcctgctactctggccatcttggaccttgatccagagaatctctgcttcaggagcttctaagagagtccagccctgcctccagagagaggcttgcccttcactgatggctgtggagcctctgatggaatattattgctggtcaggaattcactgtcttacaaggaggtttccttcttctctagacagttctgttcatcaaaaaactctccctgttcttctgaaattggagtctctggaagttccacacattaagcttagttctttttccttggaactgtccaggttacattagtccagccactgtttcacaggaccgagattaaacgatcaacatcatcattcccggcatggatcatagtctgttgtagtctacatagccctagtttatttttcttcccttattcttcaaagctttgggtccattcattcttctagtcccagtcctctggacatggtctatttaattgtgtccctctgacactgcagtgaccaaccatgatctggtcaaagaggataagagtttgagcagaaaaccatctttagcatatatttttttgctttggttcatcagccccagatatattgttttccttacccgtgcttctctcactcctcaagaagaagaaagtgtgtgttagcatctttctcttgtccttcaagacaaattggcatctcttgacgagcggagaaggttcttttttggccagaataaataaaattaaaatagaatcatccaacagaataataaat

SEQ ID NO: 139479 - DNA, 1602 bp, Homo sapiens
cattgaccttgatcaagacttttcccttctctcgccctcagtttttccagtggtaaaatgagaggactaaactagattgttgatcttcaagatgtgtgtccaattcttaacagtccgtgagcttggttttgccatgaaagaataaataaagaaataggattagatgctgaaactgtgtggtccaacacttacttgactcccctttcatcccctctgaccacttcctcccccgtcccatgcgcctgtttgacacttaccctctgctgcttctgcttcccttatagagaagcccactgtggtcactgttgagatctccgtcaacagccttggtcctctctctatcctagacatggtgagtactaagcttttttagtactatttcctagcccaggggctgacctatgggaccttccacagacttctgctttctgctctgtacttctgtaacaactccaataatttattttctggagggagaaagggattttttaaccactggtttgagaatgagactggaaaaggtaagtcccttgctacttgaagaggatcttcagaatcatgaccatatcttccagttttttcattcaaaatagaaataataaagcaatgttaaacaccacaatggactgcctcttttcttctgataattattgtatggacataagtctaaagttactagctcttgctctaagactgttctatatttttgctctacttccttctttccttttccactcgtatcatcatagtgtcagcactgcccccatttggctttcatcatctcccacctagaatacacctactccacctactaagttggcctcccaagtgatgcacctcctgcagtcccagcactgcttactacatgcagttgaaggccctccatggttgtattcctcttcacccttttagagaccacgtgctttggtcacactagaatattggtgttcccagaccaccttgtacctctgagctttcattcaagtgatcttctatttggtatgccattgttccactttcttacttgtcagctgccttctttttcagtatctagctcagacagcatctcattcatggcatctcccctgacctccacacctgttaattgctcctttctttctcataccacattcttctcttcggcagttacatctttccagcttatatcacaggtgtttacctgatcttgcctacatcatttcattgtaattatctgtggtatgtcggccttgctgtcttctccatgaactccttgatgtcaagggctccatatatgttagctaagcaaatgagtgatgaatgatgctctgcaagaatcacttgcatctgcagagcctgacactgaggaaggctttggtaagcaactccgtcacagccacagacatggcttggcccggggcaaacaaaattttggcatactcacaggtactcaaaaagtgccatgtgactgggtgagttagagccttggctctgagatgggccttgcaaatagaccctcaatgctaagttaaccttcatggaaaatcaaggtgttcgcataggctaagtggaaaagcaaggttccccactcccaaaccatgaggctttggctgcctgattctt

SEQ ID NO: 139480 - DNA, 1087 bp, Homo sapiens
acaccctccctctctccccaggcctgtgggtccccatcgcccaagtcctgcccacactcccacctgctaccctgatcagagtcatcatgcctcgagctccaaagcgtcagcgctgcatgcctgaagaagatcttcaatcccaaagtgagacacagggcctcgagggtgcacaggctcccctggctgtggaggaggatgcttcatcatccacttccaccagctcctcttttccatcctcttttccctcctcctcctcttcctcctcctcctcctgctatcctctaataccaagcaccccagaggaggtttctgctgatgatgagacaccaaatcctccccagagtgctcagatagcctgctcctccccctcggtcgttgcttcccttccattagatcaatctgatgagggctccagcagccaaaaggaggagagtccaagcaccctacaggtcctgccagacagtgagtctttacccagaagtgagatagatgaaaaggtgactgatttggtgcagtttctgctcttcaagtatcaaatgaaggagccgatcacaaaggcagaaatactggagagtgtcataagaaattatgaagaccacttccctttgttgtttagtgaagcctccgagtgcatgctgctggtctttggcattgatgtaaaggaagtggatcccactggccactcctttgtccttgtcacctccctgggcctcacctatgatgggatgctgagtgatgtccagagcatgcccaagactggcattctcatacttatcctaagcatagtcttcatagagggctactgcacccctgaggaggtcatctgggaagcactgaatatgatggggctgtatgatgggatggagcacctcatttatggggagcccaggaagctgctcacccaagattgggtgcaggaaaactacctggagtaccggcaggtgcctggcagtgatcctgcacggtatgagtttctgtggggtccaagggctcatgctgaaattaggaagatgagtctcctgaaatttttggccaaggtaaatgggagtgatccaagatccttcccactgtggtatgaggaggcttt

SEQ ID NO: 139481 - DNA, 1002 bp, Homo sapiens
gctgctcccagtgcctcctcaaccccaacaatcattgcttcacccaaggccacctacgtgcaggacagcccgactgagaccaagacctacaacagtgtcagcaaggttgacaaaatttcccgcatcatctttcctgtgctctttgccatattcaatctggtctattgggccacatatgtcaaccgggagtcagctatcaagggcatgatccgcaaacagtagatagtggtggcagtgcagcaaccagagcactgtataccccgtgaagcatccaggcacccaaaccccggggctccccttcgcgtatttcaggattctcctttttacccctctaccaagctgtgaccctcaattcatatttatgaatctctacgcaaaaaataactacagaaaaattacttgtccctccaatattgcccagtataaccccatcaaagccaaacactgccatttgtccagttgctcatcttagtctgccaatctcccctagctgagggcactgcatgtattttattgcactctgcccgctgcaaaaagaacaagagattctactctccatagtggaagccttggctgtttgagaggcccagaacaaggagaattgttgactcccatctagatcagatgactctaacttactaggcagccaggttaggctaggccatgtgatcctgcgtgccacctcccctgccttcagcaaggcctactaggcataagtactgatagcaaaggtgggagccagttctacacccccaacccatttattggtttggaaattagtggggacaattggtactaaccaccgtctaccatgtatggccaaaataaatagaactagctctgccagcctggcaccaagatggctggtgccctgccatgtccagcccctcgggaaaatagtcccctccttggtacatctctcctccagaaaatcttcttcccccactgcctttggcacccttgtagccaactgagcactacttaatttggactcattaccac

SEQ ID NO: 139482 - DNA, 1091 bp, Homo sapiens
aaatgtacgataaaatgtaaggttttggttttgtggcgatttttatattggcctttgatgttcatatggggtcattaagcagtagagacaaggtaagaaacttgttcttatttgggtgtcactgcatacaggagggagcacttgccttttcataaggcaaagtcttatgatcagcttgtgtgctgtgtggggatgtgttggcagttgtcttccttaaaaatgccttgtcaaatatgttatccccatgcttattaatctccatggcattatttctcaatcataatcattttccttacacaccaggagctactgttaatagactgctgcttctctgcatcagaggaaatactgcaaggtaattaatatttgctaagggcactatgagcccttaccagaactcaactgaaacattgttttctctcttttcacccctaggagtacactattgatgtattttttcggcagacatggcatgatgaaagactgaaatttgatggccccatgaagatccttccactgaacaatctcctggctagtaagatctggacaccggacaccttcttccacaatggcaagaaatcagtggctcataacatgaccacgcccaacaagctgctcagattggtggacaacggaaccctcctctatacaatgaggtcagagagtggtggttcccacccaaagtatattgggagtaggactgggcttgaaagcagaatgttttagagtatccattgaaaattccctcaagtgtatagattagaaatgtacaggtatgtatatacttcctaatacaattgcatgcatacatactcacagacatatatattctaataaacacataaataaagagttgcatagatgaacattttgagaaacacagaggtatacattcatgatttgtatatgcatgcatacctaaagacacatgtggactaacacagaaggacataatgtattcaaggacacttaaatacacagattcacaaaaacatacacacaggcatgaacgctgataattagaattgactaggtttaactgcaacaacaaactatccctatgatgcagagttgtgagaatcaaatgagat

SEQ ID NO: 139483 - DNA, 1031 bp, Homo sapiens
gtgtatcaaatgatatcagttgtctccaaatatgggacaattaacccccccaaaaattatttctcattcatgcaaagtctattgtggatccaggcaactctccagggcagtgctcctccatatattagctcatcattccagactttttcaattttattgtagcaccacagcaatgtgtgtttttacgatcatcatggcatggagggtcttgcattagacatcaattgttccagccatgagagacacatattactttctcccacatccagaaccattcctattgcccctctatattttaaaaaggcaggggagtggaagaacaatcatcctatgttcctagaagtggaagagtgttggatattgcaacatttgtaacctactacaggtaagggtaagcccagtgagagctcagctcttgtgaatgtcagggatctctaagggccctatctaagctttgttgttttggtattatgctgtcattttcaatgatactaaagggatagactttgagtctgtacctagcatgttccctgtgaagagatagcacagatgagaagtttttgaggggttttcctttctcagaagtagtaagttggctgtcattcagagtactgcactggactctctctgagctaagacaaaagcctttcctgacattctgcttttctactttctttcacgcagatgcagtgactgaagtgaagactgacatctacgtgaccagttttggccctgtgtcagacactgacatggtaagttcttgcaaaggtaaatgtaaaagaggatgcactagaccaaagaaaataaattggagctttcctaaggcagggccttgtagctatattctaaggagtggtcttttctcatatgaatttcctaccctcgccaccctacgtttagccaaatccatctttgccctgctctccccacctattcacatataatgtatatacccctttcaggagtgcccttatctttctcccacgacacatctttcaaaagtttgtttggttccctatccttaattaaag

SEQ ID NO: 139484 - DNA, 1039 bp, Homo sapiens
atcttcatgcttcagtttcctgcaaaatgacaaaaaaagtagtaaggttattgtgaggattgtataagctattatacataaaatatttttaatactgcctggcaggtagtgatgatgatgataacaatgatgatgatgatgatgacatgacaatgatgataatgatactgtgtcccttgatcgtgtataataattgtcagctcaaattctggagttctctaagtgtgcattatggtcaaatgctgatacttgtgatagtgtttaaagcatcattatataagtatatgccatggcagtcatttgaatcgttgccatctgtagtattctattagctactgcactatcgttttctgctattttattatcagcatcttcttcaatatccttgttcatctgctcctatattatggtcatcagcttatttttgttgggatatctgggtgtacatcgtggtttaacagtcaaatattagtgttagttgctcatgcaccatgattgcctgagtatgtgccatgatatctcctccagcatcattgtcatatgctgtttgcctaaataagttgtattcatgtgttatgtttcctttattcatatgtcctgtccatctgggcatattcctcattgtgttattcactcttgtatcacacccacctgcttttatattgtaggtttttgctcatgcaccatggttgtctgagcatgcagcatgcttgtctgctcataccccatggtttctgagcaggaaccttcattgtctactgctttacagggaaatagtgttttatgcatcgtgtatatgagtttagtatttactcatattctatgactctctactcttagatcacttctgcctttttctgcacattgtttatctgttccaaaaagacagatgttatctcatgtcactgggctttctaattgtacatcagtcaaatgcttaaatgcctatgatgtgatggctgttcatgcaacatggctgtttcagcatatatcataacttcacccgtttaatcattgccatcttctcccagactaaaga

SEQ ID NO: 139485 - DNA, 1018 bp, Homo sapiens
ggagcctttgaatagttttaagcaagggagtaaagcaatctgattcgcatttttatggccccctctggttgctgtgtgaagaataggttaatgctgcagaagggcggctgaagtgaatgtgaggccagtaatgctgctttggctaaaatggtaatctggagaaagagagggagggagggagggagagagagaccatgggtttgagaggtatattggaggtagattaatagaagtagtggaaggaatatttagcaaacactaggaagtctggctgaacttgtacttttccctgcatttccttctttaaatttatttcctaccagttttcctgacctgtctcactcacctatggggactcagatatcgttcttacctctcttttaattcaattctttcatatttaatctccaatcttctgctttattccagtgacacaagggcttggctgtgttcttgtgctgggatcccataatcagtcactccattttctttctttgctttccacattggtgacccattaagtgcattcttcattttcagtggtctattgtttttcttcaatttctggcttgctttcaatccatctttctcagttttcagctgggactaacttgagaaaaaacctctcttgctcttgagtagtgggtgtatgcttgccaaatgtttgcaaaaaaagtatctcattgtacaagtggcattccagctgcattaacacccaagcagaaataagtaaatactcaattttagaactcactgtcatctttacttgtggagtgattgcctcctgctttctgagtgcctgtttaggaatctataaatgacacagtttccacaagcatttggggatcctgggcagtatctatgctacaacaatgctcctggttatatgctcagtgggggctggaggctgaaattggtatatattaatgcaaccttcctctgtttttgtgtctagtctgcagattctccacttttagataaaggcaggttgcctgaactatgcacattgcacattcct

SEQ ID NO: 139486 - DNA, 1056 bp, Homo sapiens
tttctaatttcatgaagaaaagtaccacatttgaaatagtggtagttcaaggttcatacagtatgcagaaggtagaagaatatattgttttatcagaaaacacctcaggaataattacatcactgaggggatacaatgcagtgggactgggtggaaaggggtgagtatgtggttgctagaatggaacactgacttggctgttagcaaatttgggttccattcctagctcagatgatttgctgattatcttggacatatgacttcccctccatgtgcctcagtttttccatctgtaagatgttgagatggactgtgtctctgagggtctttcaactctgaaattctctatctgaagtaaattataagatttcagagttatgagaggcttcggaaatcgttaggccagtgcttctcaaactttaatgtgtaaaaatatctcctgggaatcttgttaaaatgcgaattgtgattcagagagtctatggcaggggcctcggattttgcattttagcaatctattaggtgatcctgaaactgctgttccactgaccacacttcaagtagcaaagctctagtagagtactggtcaaactcccctagtgaaggaaaatgtttgttgtcatttgtttgtttgtttcctaatccatcacagaagactgttaatttagtaaaataaattaaccatgaattactagaaaatgaaagaaaagacatacaaaagataagcccgcatttgtattattagattctacagacataaaatgattttttcaaattgctgtaacattttctaagtgcttactcttgacttctgtactttggtccttactgcctggtaataaaagttcacagacaggcactgatttggcgggctacattttgagtgcactggtctaggctacctgcccatctaatttaagaggcccaaattagacccagctttaatttctaaatcacctgtcatgatcttttaccctacagttaaatatctcctttaatgaagaatttaacatttacacaaagttgcattgttcatgtgttgtgacagataaaatg

SEQ ID NO: 139487 - DNA, 1051 bp, Homo sapiens
cctactctcccgggaaagagctcaaaggaaagactggtgcgctaaagccgagaaaggcgcaggagaggcggcgtggccgagctggggcctgggaagggctcagccgctgggcgtggggcgcgacagagcggcagcactcaccatagccaaaggagtccgctgccggttgttaggcaaccgacgtgtacactgactcggcgccgttcccaccgccccgcgcgcgcagccccgctccccattggccgtccgctcgtcgccgcctctccctattggtgcagggccgaagagggtgggactaacctggcaaagccccggcccagcgcggggaggggcacgctggcgacagagccccgtctttattgggcaagatcacgccgtgagcgccaattggctgagtcgtcgccgagctgggccaatcctcttggtggaggaagctcggctgattctcggctcacgcgggaggggagtaaagggtggcggtccgggcctggagttcagtgggtgcagcctgcttgcgagctgaggccagacaggggggcgcctacggacgggtaagagtcgtggccttgccattggaggtcaccctgtgtcagcgactgggcagtgcgggagggtggggagctacggggtcgcccgggtcgggtgctttctgggttgacctaaggctgagtttagggaccgagtgcatcagagcagccagaaacgattaccttgcgtgttggagcagggactgtactcacggggcaactgagacccggagaggggaaggggtgtgctgagtgttgtcgcagaggtcggacggctgggacctaggaactgaatccagccgaggctcgctctttgagggtggcccttcgagagcacccctagactgacccagatgtataggccccagaccaggttccaagagaggatcactttagatcttacctggctaaaagcagcccaggacggtgaactggggcctttgggaacggactttgaaaggagtgagggggatgtgagcgagcatgaggggcggggagaggtcatcaaaatatactctttttga

SEQ ID NO: 139488 - DNA, 1025 bp, Homo sapiens
tgtgtattcctatgtgtgttcacatggccaggtcactatcagaatagccagtgatctttttcagacatcttcctagaagtttgcgggctgcccttcacttacaacagagaatcgctgtcatagtgagataccatgaatgcaagtctattctatctctcaggtgtgatgggatagaaaaaatgtgttatcccttgttttgaaaccaagatctcttgattcttggttagaatgtaatacatagtgtgtctggaatccacatagctgcaaaagatggtgatctttggattattttaagaaggcatgaaaagcaaaggcattgcagcaaataatttcttcagtgcctcgaatgcgagggcaacaaagggatgcccctgattctctttcatacaggatcatgcactgtttgaattgtgataatttgtgacttttattttttctgaccttcctctgtcagaaactcattttaaccagcagtgccagtgtcatctttgagggcgtcgatatcaagaatggaactgaagaccttccctatgccatgaaacccattgactactacacagagactaagatcttacaggagagggtatgtaccttggaactggttgagtgagcagactgaagggtttagaatcctaagaaaaatgtttatgaacttatgaagtttgtattctgaggcctacgtacctgatttgagatgtaaaatttgtgggtgaaattaaatttaaaaatactgtgagaggccgggcacggtggctcacgcttataatcccagcactttgggaggccgaggtgggtggatcacctgaggtcaggagttcgagaccagcctggccaacatggcgaaaccccatctctactaaaaatacaaaaattagcccagcatggtggcaggcgcctgtaatcctagccacttgggaggctgaggtatgagaattgcttgaacctgggaggcggaggttgcagtgagccgagattgtgccattgcactccagcctgggggatagagagagagagacgctgtctcc

SEQ ID NO: 139489 - DNA, 1049 bp, Homo sapiens
cttttattctcctgaacctctgccgtttccccactgataaccttcaaataagttgggaatagggtgggtgtggcattttttttttctttttttttttttgagacagtctcactctgtcaccctggctggagtgcagtggcgtgatctcggttcactgcaacctccgtctcactggttcaagcgattctcatgcctgagcctcccgagtagctgggactacaggcacatgccaccacgctcagctaattttttgtacttttagtagagacggggtttcaccatgttggccaggctggtctcctgacctcaggtgatctgcccgcctctgcgtcccaaagtgctggggtgacaggcgtgagccaccgcgcctggcccgggtgtggcttttgatttaaaacaagcagaacaccgtcaagaaatgtaatatgaggaattcattgcatccaaagatatgtagatgagttttatgatgattaacaattatcaaattaacaaatgtgcctttccaagtgcaatctatgcttcatttaaaatcctggcccatagatgaaactttcattgtctgccctttctatgccttagcagttgtgcaattgagggcaggccacgtggaaagctgcagcaattaggcagtgagaatgcgatctgcacgggcttaatagatgcttcaactttgggcaggtgggggtggtgtttctaacttcttgttcttgttctcccgccaggcatttcacatcaccaatgatgagcccatccctttctggacattcctgtctcgcatcctgacaggcctcaattatgaggcccccaagtaccacatcccctactgggtggcctactacctggccctcctgctatccctgctggtgatggtgatcagtcctgtcatccagctgcagcccaccttcacacccatgcgggtcgcactggctggcacattccactactacagctgcgagagagccaaaaaggccatgggctaccagccactagtgaccatggatgatgctatggagaggaccgtgcagagctttcgccacctgcggagg

SEQ ID NO: 139490 - DNA, 1062 bp, Homo sapiens
aggtacagtgagtgctggccccctggcttctgcccatacttagcactccaccaacgcttgccacccccgatgtgcagagggcagtctggatgatcttggtgtaccaggacccatatggtcacctgcaagacactacaaatgcatgaagtgacagcatttgcttacctttatccccagaagccctgctgaatcaagtgagaggagagctgcggagcaatcaccatgagtatctcagctcttggaggccgcaccaaaggtgaggcctgggctccctggtttcccaggctctgtttggggctgtttgcttccaagcctgcccctacaggccacaagcactgtcccagcagcaaagggagagcagcatactgggagaactggaaaggaggtcgagggtcctggggctgcattcctcttctgaggcggttggcttttcccaccacagggaagcctctgccaccaggcgaggaggagcgcaataacgttctcaagcagatgaaagtgcgaaccacgctgaagggggacaagagctggattaccaagcaggatgaatcggagggtcgcaccatgtaaggcaaggaggcggggagggaccgcagcaacgtgggggcgcgcaatccgtgggggaccgaccatacctggggatgcgaaggggcttccaccattcagagctccgccaggccatgtggagggcagagcgtgggaaaggctatccagcaatgtcacagggtgggagagcccctgggtgcctgggaaggagaatgtgtggcagaaatggcaggacttgctgggcagcctctaggatggaggccacaggatggcaggtgacagggagtctcggagccaatccttcaggatgcctctttcccccagagagctgccctcaggccggagtcgcgccacatccttttcatcagctggggaggttccgaagcctaggtaagaggtggtgctcaggtggctggtgggtcagccccagggactctcctgcagcttggggccagccctcaacagggaggggtgggcagtccacaggggacagggatgcagccccagccaagggtc

SEQ ID NO: 139491 - DNA, 1050 bp, Homo sapiens
gagggagaaaccatcccaggccactctcctggcttctgctggtggttggtgatccttggtgttcctcggcttgtacctgcatcactccagtctgtgcgtctgtcttcacatggccttctcttctctgtgtgtctgtgtccagatttccctcttcttacaaggacagcggtcattggatttaggacccatcctactccagtatgacctcatcttacctgattacatctgcaaagaccctatttccaaataaggttacagtcacaggttccaggggacatgaattttggggggacactattcaacccagtatgctgtccttatcctgagctggagtcactgaacccccagcctgggccacctcttggccgtgatcctgaagggttgggtcagttagacgccactggaagcatgttctttgaggcctccaagctctagggcagccaagaagaccacgagcgctgtttctcttcttgctcaaagggtggaggtggtggaagaggacgggccttctgagaagagccaggacccacctgctctggcaagatccactcctggctcaaacaggtaatccattgcgctcatctctgcctggggctggtggctgccatacctgccactcagtcactgaggaacctcagtcagggcacctccatgctgggcttcgagatcagtgtccccatgtgcccagtgacaagacgggacaaagaaatcagtaagagcccatctggctggatgtcccagggctgaaaggagcaaaacagtccagccccccgggagagagcacctggctctggtctgatgagtacgtatctgtgtcaccttaacccttgcaccactgagcctggtggcaacttgaacaccccaagaaaaagtaccatccttggggtttgagagggccagccaccatggcagtagcatgccattgtcagacttgctccttgcactccaataagttagccacattcagcatgcccagggaggaggctctgacatctccagagcctctcacagccaccttctttgccagtgcggatggaggcaggaccaaag

SEQ ID NO: 139492 - DNA, 1053 bp, Homo sapiens
caactctagaaagaacacggtggagagagctatagataaggaaccacaaaccaactaaccctgaggtgggaacatgcttagcatgttccaaaggacagagtggctggagcttggccagtgaggagggccacagatggagcagggccttggtaagccatggttaagagattggatcttatttcaagttttaagccaaaggggagtctcatgtgatttaggtgtttaaaaggtgaatgcatgtttgcattttcataccacattgctgttgcttttttacttaaaccaagatgctgggggctggggtgggcaatggatatctaaggtatgaggccttattgtgtttcttttctcattcgaattgcactgacaattaacaatcagagtgaaaacaacagctgacaccaatactgtgctgtgctaggtgccttacagccttcccagcaacttgtgagatgggtaaggtgggaaactgaagcatagaaagattaagtgacttagccaaggccttacaagtggcagaactgagttccaagggaagaggctctaagaaaatcctcaggagaaactacgaaaaactagtttatgaaatcttgtctttggagcctagtctcaagacccagaatcagtaacttacagctggttaacatggttaacatgctgtgtgatctcaccttaattttccccaaacgtggaaaaggataaggcttcttattatgcaacttgacagaggagaaaattgagggactcactcctgtaatgaacacacttaggaacagagcccagatccagccaactctagagccaggctcacgctactttcctctgatgtttaaacgtctgcaaaatcagaggtgttttttttttttttttttttttttgagacagagttttgctttgtcgccccagctggggtgcagtggcgcaatctcgactcactgcaacctctgcctcctgggttcaaacgattctcctgcctcagcctcctaagtagctgggattacaggcacatgccaccacgcccagctaatttttatatttttactagggataggg

SEQ ID NO: 139493 - DNA, 1457 bp, Homo sapiens
gctgagtgggctcctggtgactgtcacattatatcataggtggggaggaaagctctgctgttttcccactggtcagtggggtccccttggcatatacaacctcaggaatcctagccacccagccccgatcatctccctcattgtgaaaggtctcctttgcccccccatagaagggccctgtggcaccaagtcatgaatgacgactggcatcgtagttatgtctcagcttgtggccaaaggttaattagaaaattaactatgatagtgatttggctctcatctctgccctcctctcccctatcaaactccctgcagcgtcagcagcattgaggactcattcgccatggagaagaagcctccatgtggcagcactccatactctgagaggtatgttgactttcttagcacggagcttgcacttctacagaggagaatcagggaagggagagttcctgctgagtctgtttgcttttgtcttctgctttgcagcctccaatccatttgcagaaaggtgaaggacactaccgtagggtggtgcttcccttgttgggatatcacacttgtgacaactaaagcctttgaattgagctaagactagagggtagataccagcggtgactgagaagggaagtggtggcatctgacaacccagaggactcgtgtcagcaggaggggcccttcagattagaacctaatcaatcacttcattaacttgcaaatctaaccagaagtaaaaataaaatgactacaaaagagaggagtgggcagagaaggaagaaaaatgggctgctggcatcaagaagccagaaagacacacaaagccaagaatgcccagtgctgtggagccaccaaattgaaagcaggggcagagaacacctcgttcagcagttttgaaagctgtcactagatgatggcacagtcactagagagtcttaatgacaaagaaatcttatgttcagattcttggaatggggagaagagagtctcagagattgagttcactcaggcttctgtgaagaaaatggaataaatagccttcagtccacagtaagcaaatacggcagacccaggactaaaccccagggccctgactactcccaggttagggatgtttctactctgccatcttgcttctcattgatgggcagatcttaattcatgtggatgacattcagagaccaaagctacattggggaggaaaaggaaggaagtaagagggttaagataaagagaatcctaccgggccccagaggcaaacatataggagcagacaagcatatggggccagggaatctcctccactatagctgaagaagcaggtggttctgagtaactacagattacttggtgaggcacatcagcagatgaagtcttagcagagaagggcaggttggtcagaaacctgagagttaaccacttacataggagcaaatggaatgaggcttccaattctagtg

SEQ ID NO: 139494 - DNA, 1059 bp, Homo sapiens
gcattggtcttcctgctctagagggtagcaggccccagcggataatctaagcagaaggtcagggggaggcaaactgtctggaataagtatcatatcaggacatctacaggagacatgtcattgtgagctggaaaaagatgcatgactagtttttggaaataatgcagaggtctacagcaggctgagaactgatctggcccagggctgtgctgcacaccacagaaaacagtggcatcctggggatcctgacagcaaacctgggcctggctgcaccaaattggaaggtctggctgtgtcacatcagaggtctgtacaccagcctgaccaccgggttattgttcttcatctcacaggacaactggagggatctgtacttactgcaaccgtgagatccgagactgtccaaagattaccctagaacatcttggtatctgctgccatgaatattgctttaaggtaaaaaagaggtggaagacaccttgagctaggcggtaactcctgatcacgtgctgctaagaacgttttgtagagtgcgggagtcttacgggttcagagactgtggaggaggcttgatctccatatacaattgcacatagtcgcagaggctttgcacaactgggagctgaatgagcttccaagtctaagacagtagatgagtgttggtggttctgcatgcttagtactgtagggaagacaaaagaggtcttttcaggaaagactatttctggcagagggccagcaagtgcaaaagccctggggcagaagcactagagtgttctagcttgcgtgggagaatgccaggagtgacagagtgggctagatcatgtaggccttggcgggcacagagtttggattttattctaagtgacattggggtccccattctccacagtgtgtggcactttgtaaccccaggttgttggttccaatccatttagggtgtcacctctgggtgcactgagaaaaacaaccctcccctttgccttgacagaatgttaggcaggcttctgtcctccccacagggcctgaactttgcttgctcctggttaagtaagtgct

SEQ ID NO: 139495 - DNA, 1051 bp, Homo sapiens
gtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagt

SEQ ID NO: 139496 - DNA, 4235 bp, Homo sapiens
aatcacagcaaaatacctctgctttgccttggacagatccagtgaagcaggacccatcacgcctgagtcaggaactgcctaactggatagagttgaaaagcagagcgagtctgaagtggctgtgttattgcagcatccgcgctgccagcagggccaacccagcaaggtgagcagctgtgagttgggccctgttgggaggggctctggaaccctggcaaagagtggggagaggggactgcctgccagggttcacagactctgcagggtagggccatctctagggcaagagttgttggtttcctgcagtctggcagtggggaccttatctgggtcccttttctgcctgatttcagcttccacacaattgaaaccatgagctcctgtcctttcagcactcactcctcatgcccatctcgccttccctctcccaccctcctttttgctagtacgctttattggttggaggccaatgacatcacctgttgcttttcaaggaccttggccttaccacatgacactcccctgcaatagcaacccatggtccatggtattctctgtatccatggcaacactgcagcttgtcacacaatctccacacccaccactctcattgcattgcgcagagctcagccatctttctcatccgtcaggcattcctgagaaagagggccactctacctctcttgctgccagccttcactccagcaaggagggtgctgggtgacctgagcccacatagccccgagtgagcagtgaggctgtctcctgccctcttctgcctggagggctcgtcagtgtccccaggtgtcaggccctgcctcctgacgttggccttttcactacaggcacccgaagcacacacagcagagtcctctggactttgaggaagaacccacagcaggaggaagtcagcagggagtggtgagatggggagatctttgcctggggagaacctccacactctaccctccccaaaatgacttggggaaccctgggaagaaaggactccatccctgcttgggggtgggggcagaggaggggtgcttgggggcgtaggttggggtgggcattaacaatgctctcatcccatttgctttgcaggctgtgtgaaacctgggaccacttctgccttcctacgtggcagtggctcagagttatttgagtgctgtcaaactgagctgattgctgccctagtattagatcagtccatagaaagtgggagcaatggcactgacactgctagaggattggtgcaaggggatggacatggaccccagaaaggccctgctgattgtaggcatccccatggagtgtagtgaggtggaaattcaggacactgtgaaggcaggcttacagcccctgtgcgcatacagggtcctagggagaatgttcaggagggaagacaatgccaaggcagtcttcattgaactggctgacactgtcaattacactactctgcccagtcacataccaggaaagggtggctcctgggaagtggtggtaaaaccccgtaacccagatgatgagtttctcagtagactgaactacttcctgaaagatgagggccgaagtatgacagatgtggccagagccctgggatgttgcagcctccctgccgagagcctggatgcagaggtcatgccccaagttagatccccacctttagagcctccgaaagaaagtatgtggtacaggaaactgaaagtgttttcgggaactgcttcccctagcccaggcgaagagacctttgaagactggctagagcaggtcactgagataatgcccatatggcaagtgtctgaggtggagaagaggcggcgtttgctggagagcttacgtgggcctgctctgtcaatcatgcgggtgctccaggccaacaatgactccataactgtggagcagtgccttgacgccctaaagcagatctttggggataaagaggactttagagcctctcagtttaggtttctgcagacctctccgaagattggagagaaagtctccactttcctgctgcgcttagagcccctgctgcagaaagccgtgcacaagagccccttgtcagtgcgcagcacagacatgattcgtctgaaacatctcttagctcgggtcgccatgacccccgccctcaggggcaagctggagctcttggatcagcgagggtgtcctcccaattttctggagttaatgaagctcattcgagatgaagaagagtgggagaacactgaggcagtgatgaagaataaggagaagccatcagggagaggccggggggcctccggtagacaggcaagagcagaagccagtgtctctgcacctcaggccaccgtgcaggcaaggtcttttagcgacagcagcccccagaccatacagggaggcttacccccattagtgaaacgcaggcggctgttaggcagtgaaagcactaggggagaagaccatggccaggccacgtatcccaaggctgaaaaccagactccaggcagggaggggccacaggctgcaggagaggagttgggaaacgaggcaggggctggggccatgagccatcccaagccctgggaaacataggctcagaagaccgaagcactccttcccctggcaggcagcagggacatttgaacaaggggaaggggcagcttacactaacagggaacttgactggggcagagggacagggaagccaggtcgagatcaagcccccttactttccaccagctggaagggacttcaccaaccaagaccaaatagcatctggttcagtgggggccgggcccatagcccctaacaggtacaggagacacaagcggggaaccactacacttagcacatggggtgcctgggcttcagatggggaccccagcgaagcaggggctgaagaaggtgtggctgggggctctggcctggtcctctggacacccccaaatatctaccctgtggactttgagctgagcatgcccactggcacccaggccacgtgggacctggaggagcctgcctggggcctgcctctgccagaaggagccagggctgctgaggaagagctgtggggcagaagtgaagccccgcaggggaggccacagggtccagcctgtctttaggatcatctacactgcatgaggggagccccaggaaggcagcattcataagcccctgcaccagtgaggaagagaaagaggaggagaattaagaagaggatgatcgggaggaggaagaggagaataaggaggagcaggaggaagagggggaggagaaggaggaagagggggaggaggaagaggggaaggaggaggaagaagtgtaagaagagaagagaggatgtgttgggggtgggtagttgtttttggtttgcgtcatcatcaggcccgggctctgctcactgctgttccgtgtcaagaactccacctctgctttgccggtgtagatctcggccagtggctgcttgttctcttggggatgtgtgtgtttttatctgagcagctcctttccagagtaccccagcgcagttccaggagacggtgggaaggaggcatggcagacgctcaccttgtgactgtgacctcgactgcaggaggaccaaccagacacgggaaggagcagggctgcctgaggctccccaggaagctttgtgctttggcgttccacccctgctgttactcgtgactcagtttcctcaacttggtggggtgttccctgctatgttttccagcatcctgtgactgtcctgtgcagtctatagggcagggccctgccccagcgggtgggctcaggagggggttccctgaagcgagtacacattgccagagcccaccatcctggcaagaggtggatcctggggccctatggaaggagggatgtggtggggggggccacactgagggaggggccggggacttgtgacctgtagtggctgtttgcagtttctctctgtgttagattcccttttcttcagcagtttcagttcatgtttctcttcagtaaattttgttcagtgttccagtggtgtcttgcctctgctgtgtgaaactggggtgggaggtggtctgctggggatggggccacagtggccaggctgacatcgaggtgtgtgtggggcagggtctatgagggcctgtggggtgccttgggctgcatggagcctggcaacaggatgctggtggtcatgagcagtgactggctgggtaccaaaggcactccaggtgtcctcaggaataagtgacttggacattgaaggc

SEQ ID NO: 139497 - DNA, 1381 bp, Homo sapiens
cattccttcgttccttccttcgtctgctggtcgatttgttcgctcgttcattcattcattcgcacgctcattccactcctccccacctccacccaagcgtccagcccgcgcgcgccgctcccccgcaggctgatcagacttgcctgcccagtccgcccccgcccaaaccccgcccccttcccgccacgcccccttcccgggccaatcggggacgagactggggccggggcggggcctcgctccctcagaacccccggcggcgctcacggctccggaaacgcgccgcggggctgttagctcggctgggcacgggcggctccgtggcgcttcctgccacgccaggcctgcctgggccgcgccagcgccgctccaccgagggccgcgcgtcggccgccgccgggcctgggtgagtgtgcgggccgcgggaggatgtgcggggggcgctggaggggccgcagggcggaggtgatcgtgggggcggcaggaggacgtgtggacctgagtgagcgtgcagggccgcgagaggatgtgcagggggtgcaggactgtgtgcggggctggagcgagtgtgcgggccgcagaagagtgcacggtggagggagggggcgtctctgggcagttggagagctgctcggccttgggcgggccagagcagggaacgggtcccggatgacgagtacgaagaggcccgaaggccttcccgaggcgggcggggggcggcgatcccgggtgggaatcgctaaagtgtagaggcctgctctgctctttgggggacgctaggagatgggaaccgctcaggggcggagagaaaggacccctgcccctagctcctaggagcccgatctggagggggcattgtaggggtgggggttaaaggacttttccctggtctaggggagggactgagccgcagtctgggagctgggagggtgggccaggtgggaacagttcccgctggggagtccctcctttccttttgagtgggtgggagtgggggggggcggttaagcctcagcttggtggggagaatgggggccggtaggtagcctagagagagagctgtggagaggcaggggaaagggggcggtgagccgagctcaaggccctctgtctgaaccagtctttttctgtcgccctactgggggccgccatctcccacttcagtgcccccgcccccttaaactcctttgctggctcctccagtctatatttgggtgattaattatatatcttttccacacacaccccccactcgcctgccgcccaaagtccatggtccctttcaaacaaccccctgcccccattcctggcccacttcccagaggtcccaccctgccaccttgttccaactgaagccctccagccagccttgacctagctg

SEQ ID NO: 139498 - DNA, 1031 bp, Homo sapiens
gagaaatgggaacacaaagctttcctcaattaagtacaacaaacactacaaaatccccttctggtctaccttctggctttttatagaaaggaaataagatagaaacccaaacagaaagagacaggtgcccaggcaaagtgagaggaaacagatgccttcccacccacacatacagaaaaaggcacacacagacacaaataccccaagagagacagactttcctggtgagacaccctctctttaggcccttcaggattctgctacttcgagtagcagcctgtttgctgctttgggacgggacgggatgggcccacgtggggccttcacttccgcctcctggcctgtcaggtggaaagaacatgaaggccaggctcagcgtggcccagggcttggctcaagggttgcatcctggcctggctagggtggatccagatcgtggcagtatatattcagttgaaccctgtatctggcccagttcagtacatcccccaaaatgtgggggacatgttcctgggaggtgcacacaggtctgcttctgttcacctgaattattgcaatccaacagatggggccttacctgccaggctgatcccttggagtagttctgaggcatgatgagtcatccgtgtgtgtctcttttgggtaagtctgggtgtttatgcatggtgtctgctggctttgacgctgggcatgctatcagaagaccctataggtggggttacaacatggtgaggagtatcgttttggttccggaagcacttatattttcatctgtgccactgttgctgaactgtctttgcccagagacagttctctcaatccaagcaatacaactcacaggagaaaagatattcaggaaagagaatctggagtctaatctcccttttggatgggagagggagctgaaggcatccatctgaattggatcttttgtgagtggaaacctttgaagacacccgttgctctggcctagaactgagcagaacacaagccacctgttgtcttctgggtaaactcaagctttagggcct

SEQ ID NO: 139499 - DNA, 2092 bp, Homo sapiens
tttaaaggcagcacccaaacacccatatataccattaggcctagatgacactaagcctcacccccagtctgtcttctggctgtggcgtggtgttataggttggatattatttcactcttctctggtgtggtttgaaaagtctcaaatcttgggagctagatattaagcaagtttacctcttggagccctggtttccttctctgtgaatggaggcggtaataaccgcaggatgtggtaagtgaattacaggaagggagatgcatgtctccaaacacgtgtagtgcatgctccagggatggaagtgtgctccatttaacatgcccctccccacacacattgattcagtcaccccgcaatttatcacgtacccactcagggccaggagctgctgcagacactggggactcaggagtgaccaagaatgagaaagtgcccctgcgctgttggagctccatatctcctgggcactgtcagttagaaacaagcaatttcattggatagtttttagttagcaaaagtgttccaagtagactatgacggggactagagagtgaaggcattctaaggaggtgacattagagttgaggcctgatgtgggccaggcgcagtggctcacacctgtagtctcagcattcggagattgaggtgggaagatggcttgagcccagaagttcgagacagtctaggcagcatagtgagactccatctctacaattttttttttaagttaaaatattagctgggcatggtggcacgcagctgtagtcccagctactcaggaggctgaggcgggaggttcacaagcttgggaggttgaggctgcagtgagctgtgatggcaccactacactccagcctgggtgacagagtgagaccctgtctcagaaaaataaaaatagagttggggcctgaattctcagaaggagccatccatgagaagcccatggtattctcagcagtttcagaggccttgaaggccacagtcttggcctatcgaggattgaatgaaggccagtgtgtctggatgtcactgcgatgtggcagggcaagataaggaattggggggctgggccagggcattgtcagaaggctaagttcttaggtctctggcctgaggtcagcgagaagaggtctctaacaggtcctctttctcagaaggtgtatccacaatatccccctctacattctgtttggcagccaaacgtcaatgtcaattggaagtgaatttttttaaatgaattgtgtaagtaattcatgaccagttcattttgtactggaagccaaagtcaaatcagacatcgaatgtataccagaggaatccaacggaccagcagggccctgcccgggtgacagtgggacagagagggtgtggctgctgagcacccgaggatgaacacgatctcacactggggaagcccctgtgccagacagccagttaaagatgggaatggggctgccttggactctggggctagatgaggccttctgcccgcacttcttaggtgctgatagcttgcagggaggagcccaggaagtcacaaccccaggggcctgtctctaggctttctggtcatttcccttcatggaccgcccatagattcctgccagcccttctcccctgcacttgccttgctgtgtagggatcccaggaaatgctgggttttttacccaagcagaagggctgctccccattgactccttggcctcagcccttggcttctcacatgctgagcagctttcttactcaaagtcttttaaaagcaaaatattttacaattgttatgcttttctgataccaagaaaattcagcttggttactaaaaattctcacattacagaaaaagaaagcagatctttctagaccttgactctccccaactccaaccccatgtggtcacatacacattagagatgtgcttattctagctacaagtcactctcacttttttccttttttctcctaaaatgcaaatatatacttagccatctcctcccctccccttcccttaccctctttaggttttcaagggagaagtaactatgtctgcctgtatcatctacgaaggattcacatttttgtcatctgcagcaca

SEQ ID NO: 139500 - DNA, 1114 bp, Homo sapiens
atgtaggtgttagaccactttctcttaccccaggtcattaagatgctgtttgtttttaaaaactctttttctctctgagcttcatttgagatcatttctattgctatgtcatcaagttctctaattttcttgtgtggtatctaatctgctgttaatcacatctagtaaaattttcactttaaatatcatagttcccacctccagaagttccatttggttctttttatatcttctatttctctcactatattcctgtttttcttttaatgcttgtacatcattaaactcgctgttatccttgtctgtgagtcatcactggtcatttctgtgtgtttttattaactgattattctccttgtcctggccacatttctgtgctttttggcgtttcagtaacttctgattggatgttgggtattataaagattatattattgagtgtctggatttggggtggtagttacttgtggatcagtatgatccctttgaggcctatttttaagctttctttgagacaggtcttttgtagctttggctctaggaatagatcagccctactactaaggcctctggattctctgctgcatgtcccaggtgatcacagaggactctctatactggttgatcagaccttgaatgtctccctacctttgtgtgtcctgagaattgttcagcttacagcttcctggtcacccttttcctgggcttttggagtttcactctatgcatgcatgggcctagtagtcaggaaagactcaaggggaggcttatacagattttttgaagctctttttactgcataactaactcctttctggaactctgctctgcaacttccagctgcctcagctgctctgaatgctggcctgtgtctcctcaacttggcgaagccactaagctctatttggttctcgcccaccccaacacacagtctcgatctggaaattgcctccaggcagagagctggggcaatgatagggctcccgtcatctgtttctcttctcttggggatcatgattctgtgcttcctgctgtccagtgtctgaaaacttgtttcacatatattttctccatttttttctacttatttatggcacgatgtgaaatctgttcc

SEQ ID NO: 139501 - DNA, 2119 bp, Homo sapiens
ttctagttagggtttggggccccagctgagctcttgatggtgaggttaggttgaggatcagcagggccctttggagattcaagttatgtttggggatcccagctgagctcttggggttgaggttagggttgggggacccagctgagcctttggggacgtgtgtggctgctctctggtcacagaaggggtgacctcctcagcaccactgtggtagagagtgtccagaatgaggtccctctgcccctggcttctgcagtccttgcttctggtggcttccgggcccaggccccgtgctcagtggctgtctcagaaagaaaaagattcttgacaaaggagaggcccttccctccttcatcctctgcagactacactgccttgtgtttatcgtttcagaaagcacctccgcgacccgacaccagatgaagggggaagatgcccagccacaggagatggcgtccacaagcttcccaagggccagtggtcccagtcctgaattcagacagcacggggactctgacgggaagagagggagcccacagaatctgcccatagaacatcattttgcttgtaaagagtgtggggacacctttcggcttaaagtcctgcttgtccagcaccagagagtccacagtgaggagaagggctgggaatgtggcgactgcgggaaggtctttaggggggtggcggagtttaatgagcacaggaaaagccacgtagctgcggagccccagcccggccccagtagggccctggagaatgccgcggagaagagggagcagatggagagggaggcaaagcccttcgagtgcgaggagtgcggaaaacggtttaagaagaatgcaggcctgagtcagcatctgagggtccacagcagagagaagccctttgattgcgaggaatgcgggcggtcgttcaaagtcaacacccacctcttccgacatcagaaacttcacacttcggaaaagcctttcgcctgcaaggcgtgcagcagggatttcctggatcgccaggagcttctcaagcaccagcgcatgcacactggccacctgcccttcgactgcgacgactgcggcaagtccttccgaggggtcaacgggctggccgagcaccagcgcatccacagtggggccaagccatacgggtgtccccactgcggcaagctcttccgaaggagctcggagctcaccaagcaccggcggatccacacgggcgagaagccctacgcctgcggccagtgcggcaaggccttccgccagagctccagcctcctggagcacgcacgcatccacagtggcgagcggccctacgcatgcggcgagtgtggcaaggccttccgtgggccctctgacctcatcaagcaccggcgcatccacagcggactgaaaccctatgagtgcgacaaatgcggcaaggccttccgccggagctccggcctcagtcgccaccggcggatccacagtggggcgcggcgctgcgaatgcagccagtgtggccgcgtgttcaagaggcgctcggcactgcagaagcatcagccaacccaccacgagtagaaacgccctgtggtcccgcgggacagggacggagtccccagaggggatggcagagtcaaaggagatgaacagttttgtagcgcttatatattttgtcttccaaaaggttgagaccgatttatactgccaccagcaatttataagtgttacgttatgcccatcaagagtagcttgtaccatttaacttagtttggctagtttaactggtaggaagtaccatcaaggtatttcagtccacatgccttgaatccaagaatgagagaggacaaatctggatgtggggtagggaggggcttagaggtcatcaactccaagctccccccgccccagagaaacacacagagctgttccacgatggcgtcctcataatgtgatcccagctttcctgaagagaacgttgccctcatgatttttggcctacttgaatttataaatttttagggatgtaaatagaacactcaaatgtcttaaaatatttaatttattaatttagttatacatacatactgtaaatcacatattatataaaataatatattaatttagaaaataccccatttttgccaccc

SEQ ID NO: 139502 - DNA, 2167 bp, Homo sapiens
ggccaaacgcctagtaacagttactgaatctgggttaaatgtcggtatctttttttcttaaaccatttcaatttggtgtcccctatacatatccaaaactagcatcgattggggttgttttgaactaatgggtcttgtcctcaagcagcactattttgttcaaaataaaatagttgagagcatgcccctaagaagagatacatctcaaggactcaagtgcagggtgacgcctccttttggaaatgagcctctcctggtatcaggcctagatggtacttctccagccttccgtttcttgttctataaaacaggggtgatcacagcacctacctccgaaggttatcacgaggactgccatcgtggctgcagagtgccaggaccaccggcctggtatggaggtacacactcagtgaaggccatctgctgtcattgtcattgtcatagttattgccgtcattctgtggcttgtcaattccagaactggggatagaccccaggcctcctgaccaccagtctcatctttctcttatgcgatgacttaaatggtgtttctgttttttgcatgcaaatggtccgttcatctcctttgactagttatcaacttaccttcggatatattaactttatgtagcagttctttctatattgatggtgatgttctcttttccaattttattgctttgctttttgtagcagttttattacgtttttgttgtgaaagcttttaatttttacatatccaagcattcattttttgtccactcagtcataactttcattgcttctgtagctagatatgatgacattttctctagaattttaattacaaacaaaaagctgcaaccccagcccatcagaaggtgagtacaccaggtgggcaggctggatggaaatgggccagagaagcaggctctttcctcatccgagatgcggactccctgtctatctgtgggcaccacttgactatccaacctgaccactgcggcacactggagatgctcccatcatagattagccagaactctgtgactgctcatcattatagaccccgccagcagcagtggggcttggcctcacctagatcaatggagtggtccaaacttggtctgggagcaagcagcccagccatcctttgagctcctgggagccttggcaatgctccgagtggattcagtgactgagcagcagattcacccaagaaacatctccttggacacaagaagacttgcctagaccacatcctcctttcagccggtgactctagaactagaaagagattggttcataggcttctgctgtgggcagctaggggaaaattcacccatgtgttctggcatcacttcctatagccacacctaagtgagggcaacagagcagaggctcggagaggaaccctgcccctccgatggcttgtgcgttatgctgatagaagctggcagcactgccctgggctatgatttgcaacagccatgcccaggaggagcactaaagcaaaggtttggagggcagtggaacccttctgaaagcctgtgtggcatagaagtagaagctggtcctcctgggtctgagctaccatttccagtgggctcccccaagaggaacagcagcaagggctagcgaggaacctgcccctccagtggcccacagaagccacagatagaagccagccccaccagggctgtgctgtgacttcccagcagctgtggctggggacagggacactaggagggcctggcaaggaagtgtgcccttctcgtgggcccaccaaggctgaggcagagcttcctagcagacacaacttggaagggcttctcaggcacccatcctgacccccaggctggagaggagccaaaagcacttgttacatagtgattccttttgccctgtgggcctcagttcttgcagtagttgtgaatctgtgtctgaaatcactactttcttctcggatcctttttctcttttcgagttgttaggatgtgttttgtacagctgtcatttgataaagaaggttgacctctaccaggggcaagtctggcacctttacctagaagtactctgccatgtcttgcccgttcatttatcgtttgttgggtttcatgagggatcccattgaagtagatcccttttatgaagggatcccattgaatgcagcattaactcagaacgt

SEQ ID NO: 139503 - DNA, 1010 bp, Homo sapiens
tttttctattgtagtctatgtatttttcttattttttgttccttctatcttctagttacgagaacttagttacatgtttgtttcccttctgttctccaaatctcccatcagaatctctcatgttgcccatctcaccaaaacctataagaaagggaattctggaaaacatagttcaggctagccaagttgacacattacaaagccacctcaatccatttcttgaactctcctcaaattactcagtctgcacgtgacagtcatttcctgtcagacagctgactgttacagaagtgtagcatgttttatcattcaataaaatatttattaattcccatgttactgtccttgagccctggatgatttcaatgtgcatttcttcttttctaaacacgtggggatttttctagttatatacagtgagcttcttcctctctgcagtgagggagatgtgcgccatctcagagaaagtacgttagaaaaaaacctattagatttggacttttgtggggtattttgaggagggcccgaggaagccagggtttgctctaagcactgtcagagagcgaggacaagtctatgattgggtatcttagtaaatcttttctctggggagggcaggctagaacaaagctaaagctgtaatttgtaaagaagcagcagtcacccacactagccaagcaggaggaggacgtttggtattttgtgggttgcacgttaaccttgtttttatctgcacttagacaaaataatgaagtggccttgctttgtctcattttctcatggtctccaagtaaccttgtctgaggttagtattctgggagattgtttatgtccaataggagaacagcatggcctccctgcaagggccaggccagcttccaaatgtcagggtctgctgtttattttccctttctcttgggtttctagcttaatgacactgtggtcagagatcacgctctgaatgattttaaccctttgaaacatggtaagatttgctttaagttccagtt

SEQ ID NO: 139504 - DNA, 1944 bp, Homo sapiens
aaagcgcccagcactgcatctgctacaaagcgcttctggcatttccttgaaccatgagatgcaaacagattgtaagtttaggaaagaggaaagttggtaaccaaagcagtggagctgagagggtttcctggcaggcgggctgtaatccctggcccgcatggccacggaagctgcctgcagcccttcctgggcagccgtgcacagactggcggccccagcctaagtcacaggactctgagttagagcatgtttctgttggccgagctgtcacccaggatagctgtccttgtcagcactggccatcctcccagttctcaatctcgaggcctcggggctctgcaatagaagccaccaaagcaggtggaaaagaggtcagctgaccttcaaggggccactgagggcggccttcaggccagagggtgagacagaggtggcctgtgagggcaccaggcacccaatggggatgtgcgctgggctatttgaatcttttgacaaaatctgtcacctagctcctctgggcatcagcagaaggtgagggtgacctccccaggtgatctcggcctcctttctggctggatactggtgacgtgaatacaatgcagctgggccccccagagacccatcacctgccattgtctgggaggtggacttaaaactgactttcaaggcctcagacaggcaccaaaggccttttctcctgggaagcaacagtggggttggaggagtcccaggggagacggttcagctattcaccttcatgaagacctcaccccacaggctggagggccccagttcctacttctctccttcagcccaagccagaggccttggggactcagacccacagaccgcataatggccccaagcccaagcttactgaaatagaggaggccctgctgcctctctctgatttcagggggccagagaagagaggtgtgagagctagggggtcaccaacagttgatcttgggctgagaaattaggaaaaagatcaaatcctaaatgacaagattttcttctagaactaccattcgcctttcttggtccacagtgagctcagatggactaggagcatcgcagggcttgtttatatagggaaatgctcctggcgtggatttgtggactgagctaaactcctgaagccagggcaggtggaaaggctcctgtcatgtgcacgtttgtctaccagtggcgccatgtgcctggctggctctggctggccagttacatatgttgaactaccaggggctctgtgtcttttaaggacatgattccagattccactggagtcaaacctatttcgtggtgcagagtcgctgggcaactagcaatctgcatgtggttttcatcgcaaatctcatctcccatgtcagatgagtagtctgctgttgccgtggtgaatcagtattatactgtgaccttgattctgggcagaaatgtacgttgccttgaccatgattacacaaaatacgttgtctaggaaacagcacagttccgagaacaggaagggctagataattcttggctttgcttggaagccacacagtgttaccttgtacccagcggggtctcagctttccttggaggcccctctgctgtctctgtgtgtgacacagacagagaggcaggacagagccagggacagacagaaagggggaaacatcagaaagtcacaggctagggtgagcctctgcagctgctgtgtgagagctgctggggagggggccaggcttctggcctcttgcccagtctctgtcacccaatgcagttccaggactggggaggtgtggcactgtgggagggcatcacccacctctgggaaatgttggttgcctggctccatctatgggaagctctgcaaatacatgcaccacaaaccccccaaattccccacacacaaacacacacaccatacaccccacacacaccacacatgaacacaca

SEQ ID NO: 139505 - DNA, 1116 bp, Homo sapiens
ccagtatgtctgtggtttagtttcctgaaattgtcattgctttgcatgggattttcatcctggtaatatttttattcttttcttccattcttttccctgagctctgcgaccttcattttatttccttctgttttcttgtcatctcttctctgagcactgcatctctcctttaagctgtgtcttttgttctgagagtcatgttttcaggactttctctgagtctatggagcattttttttttttgtctgggggctttctgcgttttctcgtaattcctccttgtggttttcatctgctcttagctctcccttccacctattgtttttgccgttgtcgctgttgccaacgtatgtgtacaacccgcattggtttgcaaaggcactggatttcaccagcatcttcccatcgtctccctcgtccgcatcatctgaccgggatgttctgccacaccagtggcctgtggccttcaatttcattaatctagtcagagatttgttttcaagtgttctattactttggggacagtgacccttagcttgggggcgatctgatttctgcctcagttctgaggaggcattgccggctcggctcggcttgttctctactccctgtccagacttagcaatgtgcggctgggcctctggctaatttgtggtctgagattgtagcagttttcaatggtatttttctctttgaagttgtatttgaagcaaggccagcccatcatttttctgtataactaaaaaagaaaagtgccaagaccatgaaggaatgttgtttctttagtctgtatcttttgcaagcagataacatcataggccatgcccatatataatatatagtgctcagctccatctgttcccagaccatgtcagtcactgggaggcaaacttccaggagctctggactggggagggggcatctgtagctcctgcttgaaggctactccaggccaggaagacccagcctatctcagctggcaagatgaggcttttcaggcaactctggactgtttcttaaactgtgacctgggacattggatcaaggaccttcaatccacttgggaaaacgttaaagaggatgtggcctggagtaactcctgaaaggccaaggcag

SEQ ID NO: 139506 - DNA, 1050 bp, Homo sapiens
tactcagttccacccataggctaaggtccgcaagcaggggtcccgggtccgaggcccctcacagaggtggagcagccctggaggggccggcagtggcaccggtcacccaggttgatgggcctttctggctcctcacctgaggcgccaaggtctggtggattctcacctgtgtgcccgatgctgtgcctcggggaagcctggcttcagagcccaggattatccttctgcttggcctctgctctgctggtccccaaaggtcacagggtcttgctggtccagctggaagaagctgctctctagttccgccaggtgccttccaggtgcttctgtcctcagatgcacggagtagtgcccacctgggtgttatttgagttctatgggcacagggtttgtcgtgtctttctttccaggagttgaaattgtagatgattttcgggaactagctctcaaggacaggcactgctctgggtgacggcttggtgtggccagcacctccgctgggtcttccgatgctgcacttgagtgcgggtctccgtctctgggcggcctcccgccgatggggtgttcactcagggggtcaccactcaacagtgctctgctcccttggggctcagacctgcctcagtaatcttggggtggagggactagagataactcctccccctttcaacttgtccaaaatgggtagtgaactttcagtactgttatggtaaggaaaaaaatgagcttatgctgcttttcaaaacaataattttatactagtctgaaagcactggcaaattatcagtaatacctccccacgcacctttagttttgcaggggtcccagtgactgacagtgtgttataatgaaatgaggtgtggcctgcggacattagaatgattttacctacaggaacatttcttttccctcctttttgattgaggtgagattcacacaacataaaaattaattttttgagacagagtctagctttgtcgcccaggctggagtgcagtggtgcaatcacggctcgctgcaacctcaaccttcccagttcaagccatcacc

SEQ ID NO: 139507 - DNA, 1019 bp, Homo sapiens
ccacaggcaacggctccaccacagcagaccaggggcagtggcagctacccagatcctcttcccagcccctgtggctcgaaaagcagccccatgcaggagagaaggaagccctggatgagcaggaaatctgacctgaaggactttccgacaccactgaatacactcagtgcgacatccagacatgcttggacagctgtgaaaacccagccacaaagagactagaaacgaagtgaggctgggatctctaagaagagagaaaacagagagaaaaaccagcacaaagatcagcatcacacaggccccagccaggcacagggtctccagggcaggggacaggggagatgaagggcagggctccggaggaggtgggcacacagtacaagccaggtgagtgcaggcgccgagcacagggtagatggaacccacctcctgccatctggagtacaggggccaagggctggggccaaagcttcaagagagacagcctgtggcctcagaggagcagccaggatgccttacaagcactgagggccctgcacacccggccttgggctctggaccctgccaagccctgcaccaagagtgagggcagagcaggaaggccgggatggaggtctagacgatttgataagggcagatgccacacgagggacacagtccggagcctaggaagacagtctagagcagtgcgcattgcggcaggaagcccctctgctgggatgccactggaagctgatggcgagtggagagggtcctggggcgcaattccaggcgggctgagcacattccccagctcggtgtcaccccgaggcacaccccaggattcctgagcttcagagtcaccctcgggatgggcagaggatgacagattcagggttcacagcacttaatgtcaatgctaatgacttcaacatgtaaaaggcaaagtctagctgacagtggggccacggatggggagcggacaggcagggcaggtgaggggctgtgtcctcctctgtctgctgggggagggggatgat

SEQ ID NO: 139508 - DNA, 1026 bp, Homo sapiens
gattctgcgcggtggggcttgtcctggcctctgtgcctggccccgatgtgcttctggggccttccctgtggggctgagggcctgctgggcgagtgctctggcctgtgacggtgtggccctgggggctgcctttgcagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtggtacgtgctcctggaggcctcagtggcagcaccctggcctcctgtcccagccccaggctgcttggttctgttactgcagacacccctggcagcggtgagttgcaagtgttccctttctctccctgcagggccagtgcctctgccaagtccgaggaggaggagaagctggcggagcttgccaggcagctgcaggagagtgctgccaagttgcacgcgcttagaacggaggtgagggtgctagctcctgggagggggttgcttggaggcaaggccctgctttgtcacctccctcagcacgtgaggcttaggcgaggttgcctgtgcaccgggcctgacatgttctagaatactgtggtgctcagtccgcggggaggtgagaggtgggtcccgtggctgggggaagggatcagcctcaggtattgggtggtgcccacgcctgagcacattgccatgtgccttgccgcacgtggtcctcctggcagcccttggcctggcctctgtttgattgcggaggagaccggggcccacaggagagtgagtgagggggctgaggctgggagccagaaggtcttgctctggcctgagtcgctcggtacagctcccctgtgtccctgtttctgaaagctttcttcctcgccctgggtgtgcagtgtctgaggtgagggccggtggcagcctggctggtgggcagggcagcctcaagggactctgcctctggctttgcagtact

SEQ ID NO: 139509 - DNA, 1026 bp, Homo sapiens
cgctggcacttgctggcatccgtcttgttgattctagccaccctgctcggtgtggggtggcatctcattatggttttgatttgcatttccccatgaccagtgatacggagcgtctttttgtgagcttgttggccatttctgtatatgctttggaaaaatttccatattcatgtcctttgcccactttttaattgggtcacttgtccagtgaggttttttttttgttttgttttgttttttttcttaattagtagacttaataatttagggtagttttaggttcacagcaaaattgagcagaaagtacagagagtctccacaggccccctgccccacacatacacagcctctcccgccatggacacgacaccctgcacacgggggctcctttgtcacagtccatgaaccagcatggacacattgtcacccaaagtccatatccagtgagtcttctctcctgtggttgagagtccgtggttctccgtgtgccaagtagttctctcgacattttgcctattactttggctctgggaaaatgtattctccacacaatttatatttgtatacatatttgtgctttagcaggcacttgacctgcttaggtttaaggagcaagttcagccgcctcccgcctcttgcctgccgttccttccagcatcagctctgtttctgcagcctttgcatggctcttcgggtcccccctgtgtgtgcgccacccagtggtcagcctgggagactttgctgggctcaccaagatcagatccacttgtgcacaggtgggcctgagcccaggcattgtaaacagatttgtggggtcactttcttgagccgtttcctctccactgtcttttggatactttctagttccctggggctcccttttcctgtcctccagacataaaccacccacttccgtgatggtggtggcacggccagctccctgccagtctgcaggagaactcggaatcctggtgttcctccctgacccacctgctgacattcgcttctcagagcctgcgagcacct

SEQ ID NO: 139510 - DNA, 1019 bp, Homo sapiens
ggggagggtgccaggagcccggggccagccctcaaaacccacccgctgcgccatttcgagaaagagccctgagtgctggcagcttccctctctgcctctgctgcagccatcttttttttttttttttttttttttggtcttgagaagaattttcatttcagtatccagattcatttctgtatccagatttccgaggtaaacttcctggaatattctttccctaataattaatggaaatgaaatccacgtgacacagaagtaaccactttaaagtgagccgctccgtgccgttgagcacgtgcacaggaattcacttcttccagcgcgtatagagggcccagggggattctctggctgtctccggcctgaccagctctgctgtttccctgcagggtctggccctcactgcaggacaggttcagctcactgaaaggggtcccaacagaggtgaagatccaaggtaggtggaatcttggtccattctgagcttgtccacagcctccttatggagtggtggtgcatgttccattggaccaacgttttcttttaggtggtgcatgttgtgtggatgttgctagagccttcttgaaccccacccttccctaggcatggcaggtgggagaactcctctcgcagggacctagagcacatcagtccctgcagcgctggtggccagagacagagatttttgccgatgccagcagtggttccgtctccctgtgtcagtggtgtgtgacacgctctctacaggtggcatttctaggggcacctgctgctctccagcggagcttgccttataacctcctttctatcatttcttggtagaaaccgtgcttaacctggtaatgaatgttggataaaggtgagcaaaactgcagtccccaagttggtggctaacttttcatcttcatggtgatctctctagaagttggtggaatgtcaaaggtcaaatttttcatgggcctgtgtctgttctggccactccagggtagataagctggaccctggagtcctgatcc

SEQ ID NO: 139511 - DNA, 1048 bp, Homo sapiens
aagcccttgagggccaatggctaggattcctcctccacctcctccacgcagcctcatggacgcccccgccctaaagcaggcttctggcagactcagaggcgtgggggcctgcagacttgctgatgaggagacatttcatcgcctgattaagccaagtcctgtccgggatggggaggggggtagtggaagcagtgaagggagtggagtggagggggcaccctccttgccagcagcatccactcccttcctgcctggagccctctgcccacactccgccctctccgcctcccgctccagggtctggccgtccctggtgagggatgggaacgcagtgccaccacacacgcggaacaccagcccctggcatggagaagacaggtgggtgctggtgctgatgatcccctcgcctcttcccccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcgggcgtcctggacccggactctgtcacacccacctacagcgccatgtgtcctttcggctgccactgccacctgcgggtggttcagtgctccgacctgggtttgtccctgagtgatggggagcggggcatgcagggaggctcaggtgcagcctgagagccccttctgaaggggacacatgctggtcctgtgggacggtggcgagcatgatgtaagtgtaggaggggtccagccgtctggctgtgagctgtgcagtttgtgcccacttgtggtggcatccccgtgtgcccgtcagtgtccctgtgtgtgtgtccccggtcctccctaccagtggggctagtcggctggatggctccaagttcatgctggtgatggtggtggggcccctaggtctcgagttcatgctggtggtgggggtggggcccctaggtctcaagttcatgctggtgatgggggtggggcccctaggtctgaagtctg

SEQ ID NO: 139512 - DNA, 1050 bp, Homo sapiens
cgatggcctgaagctcaactacctgcgcatctcagaggccaagctgactggcatccccaaaggtaggaagcccactcttcctgcacgcctgcctgcctcacccccaacagcacagatggccagggtgggggctctggatgggcccgatctactcagggaaaggctcaacagtcccctcccgccacctggggcagagctagggcccctgccctcagcacctgcattctcccctgtgccctcttctcctggcagacctccctgagaccctgaatgaactccacctagaccacaacaaaatccaggccatcgaactggaggacctgcttcgctactccaagctgtacaggtgaggccagcagggcaccgcccaagggtgatgccagagtccctcagtgctgtgtggcccctcgcgcccagccccccatccttacctccagcctttgagtccgtgtcattctcccgctcacaggctgggcctaggccacaaccagatcaggatgatcgagaacgggagcctgagcttcctgcccaccctccgggagctccacttggacaacaacaagttggccagggtgccctcagggctcccagacctcaagctcctccaggtgagagctgggcatgcacagccaggttccctaaggctgggctgggggaggcgtgtgtgtccccgggcagtccctcagtcccctggccctccttcccgaccggctctgggcatctgcaagggagcggtcctgatgctcccagctggtgctgaggaggcagggagcaggggctccatggtggataccgagcaaggcagcctggtagctcttggacccgagggtctccaggtgggtcggacaccagaaagatgtggcagagtccagggagtcgagaaactgtgggcgtgggagtgcacagatctgtgccaagacagtgaccgcccagggcaggaagtaggctgacgagggggagcagggtcttgcctgggattctatcgggagcttccatccctggcctggcccgcaaccaggtgggtgatcttggtcttgcccagccctgctc

SEQ ID NO: 139513 - DNA, 1081 bp, Homo sapiens
cctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcagtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggg

SEQ ID NO: 139514 - DNA, 1045 bp, Homo sapiens
gagcaaatggagacccgagtcctcacacggacctagacaccccccaccaagcccactgccccatgcctccttggaaggcagtggccaagcatgtactctccaggggctgcgcagatacctagacaaacacagaccagggaggagggaaagggcctctgtcccagcagctcaccgtgctgtgggggatgcccagacctcgcctcgtgctgactccagtggtcctagcacacccagcatggggcaaaaaccagatccggccaccgcctggtccttattaggccccaccatatgcccagcgcactgcctgtgctcaggaaacagcagggaggagacgtgggtttttttttttttaattgatttcttcctatttaaaaacaatactcttaatatgctctctataggaaacgtataaaacacagagaagtcgaaaatgtagtaaagccatcctatcatgcaaatgtaaatccaacatctccatttgattcatttcacattgctgtcattataccatgggctcaattgtgtaatctgttttttacttcacataagcattttctttattaatataatcccttcctaaatgaatggtttttttcaaaatggttatagtttaattttttaagattataaaagcagtaagtgcttattgcaaaaagaaagaatgatcttgaaccatgcaaagaagaaatttgatcattcaacagttatttaccaagcacccgggatgtatcaggcggccttcagtaattacaatttttaatggctgaataatattctcccaagagattgtaattcgcttaattatttggctatttttggaaacccaggcagtcagatttattttgctcttatgcgtgagctctgctgaggagcctctgtcctgaggagagggcccaggcagaggtatcttctgccaaattgttctccaaaagggctttttcatcgcactgcatggtgtcgctcactgcaaccttgccagcattagatattttaatcaaacaaattgtcataagtatctaggtcaaaaatatgtactttactttat

SEQ ID NO: 139515 - DNA, 1050 bp, Homo sapiens
ccttccagtgccccctcagcggtagtgtggaggtggccaggaaagcacagggacctgggacccgctggagtccaggagcctcctggcctgttttgtcatctgtgtgtcaggaggaggatggctagggactccccatgacagcagccagagagccgcatgctcactcccacgtgcacacccccagcagtctgcagaaaggctcctgtctagagggagagccaggcgctggccagacggccccagagggctgctgccaccccaggagcagtcagtcagggccacataggaggcctgggacacacaaggccgacccgtcccatcccatcctccccttctgtgcttccggggcaccatgcaggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaaggtaaggcccgggggcctgggctggaaggaggaagaggaatggggcttgagatgagggacggtcacaggatggtgatgtctcctccactgcttcccttctgtcctccgcacagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggtgagtgccctggtcttcacccaccctgtcaaggaagctcggctcctgcttctggggagggtgagccagaggagacccccagcacaggttctccccggtggcctgcgtgtcgtcacctgcctta

SEQ ID NO: 139516 - DNA, 1043 bp, Homo sapiens
aatgttctgggaatagacagtggagggatataaacctcggagttatgtactttcaaaaggttaaaatggttctgttgaagtttgttatgtgattttttatctcaatttaaaaaattgttttgaaaagaccaagttgatcagcaggcaatttaaacaccccctttctaaggcggggtgaagaaaatctggacactcaccaatggggaaaatgggactgttgagaaagggttcccatgggacgcatagcccacgcagaaactcatacacagatgctcctggcagcaccattcacaagagccaaaaagtgggaacgagccatgtgtccatcagggcagacatacataatgtggcagtctgtgccgtggagtgttatgaggccatgaaaaggcagaaagtcctgccctatgctacggtgtgtgtgagcctgaaaacacggtgctaagcgagatgccagacacaagaggccacatattatttgatcccataggaatgaaatgtccggaacaggcaaatccatagacccaggaagcctgtgagtggttgccgggggctgggatgtttgggggagaaatggggaaatgactgctcaagagcacagggtttctttttaagatgatgacaatcttctggaactagatagagccaatggttgcacaacgtggtgaatgtcctacaaattcgagtgctgaattatgtacttgaaaatggtgaatttttggcatatgaatttgatctcaattaaaataatctgcagcaaagaaaacaaaaccctcactctcacaatctggccctcaggcctgagcccaggtgtcctagctggggcatggcagcccccagtacccacctgagtaatgcaggcacctgtgaaggccacgatcacagccaccacattgaccgtcagttgaaactgcaggaacttggagatgctgtcatagacgttacggccccacatgactgccttgacgatgctggtgaagttgtcatcggtcaggatgatgtcggaggcctccttggccacgtcggtccctgcgatgccctggggg

SEQ ID NO: 139517 - DNA, 1047 bp, Homo sapiens
caaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggtgggtactgggggctgccatgccccagctaggacacctgggctcaggcctgagggccagattgtgagagtgagggttttgttttctttgctgcagattattttaattgagatcaaattcatatgccaaaaattcaccattttcaagtacataattcagcactcgaatttgtaggacattcaccacgttgtgcaaccattggctctatctagttccagaagattgtcatcatcttaaaaagaaaccctgtgctcttgagcagtcatttccccatttctcccccaaacatcccagcccccggcaaccactcacaggcttcctgggtctatggatttgcctgttccggacatttcattcctatgggatcaaataatatgtggcctcttgtgtctggcatctcgcttagcaccgtgttttcaggctcacacacaccgtagcatagggcaggactttctgccttttcatggcctcataacactccacggcacagactgccacattatgtatgtctgccctgatggacacatggctcgttcccactttttggctcttgtgaatggtgctgccaggagcatctgtgtatgagtttctgcgtgggctatgcgtcccatgggaaccctttctcaacagtcccattttccccattggtgagtgtccagattttcttcaccccgccttagaaagggggtgtttaaattgcctgctgatcaacttggtcttttcaaaacaattttttaaattgagataaaaaatcacataacaaacttcaacagaaccattttaaccttttgaaagtacataactccgaggtttatatccctccactgtctattcccagaacattctcatcaccccaaaaggacacccagaccccgtga

SEQ ID NO: 139518 - DNA, 1054 bp, Homo sapiens
ctccccttcctcaccggggctctctgtgttctggccaggccagggcataggtgacagtgttcagagtccagacctaacacatccttcccaggctacgctgtgttcggtgcctaggatgccagcctcgcctcccggttctcagctggagaggccccttggacccctggggggctcttgaaatgtggagttctttgttgccccttgacctagccctgcgtgatcgtggtctctgggggactctgtagctctggaaagttttgcaaggagcccgtggtgagagtgagaggagtcaaagagggctttgtaagcatgagggcccaggggacgcagcgggagttggggaggtgcagtggcacaggcgggcagagggcatgattggaaaggcagccgggggtgcaggggtgcaggtgtgcaggaaggttggggtgacaccaagaggcaggggcttgaaggccatggtcaggagcgtagacttcatccttaggacaatggagagaggctccaccagtcccactgcagagggtggtgttggaggggctgagctgagccaaggcaagcaaaggaggctgaggcccagggagtggggttgccctgaggctgggtcccttgagactcggcccttgagaccactgggagggaacacaggacccagggcaccaagaacagctttgtgcaagttgcatggatgattctttgggacaggcccttggtgatgtgtgactgaccctgggaaggggtgtggcctcaggccccgcctattcccgcttgagctggggctggtggctcaggcgggccctggctccgcagccaagtgtgcagtggtgtccttactctggcaggacctcagggaggagggtcagtcgctccatgtcaggggcattgcaactggggatcctggacagggcctggaggggcagggagtgatggctgtgacctgagagatggtggcccaggccttgcagaaggaggtggagtgtgaagcatgctgggtggccctctggaggctgctgggggaggggcaggccatgaaggagaggctgcaggggctgcggtg

SEQ ID NO: 139519 - DNA, 1005 bp, Homo sapiens
aaggagaaggccgagagggggcgctccaggtctggagcaggtataattggagcatttgcactgagacccctgccagagaggagaaaaccctttcaagggaaattttaatctaaaaggaaaaaaccaaaatattgatgagaaggagtcctccagttagtgaaaggggagtttcgttttcagctttctttggttcctactccaattccacatccttcatcctggccatgcccccaccttcaagagcatgaagcactcttggagttgtgggtcctgcccagagtccagagagcagcctcagctgagcacaggtccgagggggcgggggcagggccaagagttcaaaagaagccaatggagggagagggagcgtcagaagcccggaggagctggtggtgggagaatgacggcagggacgcagccacagttcagaccctgtcccctcagcacctggatggactcccactgtttgctttggcaaatgccgaggagtcctcggtagaccaccttgatgtctgctgtgacatcagaggtgccaccaccaaagcactcttcccaccctagtctttgtgtccagcggccaagcttaagccatgaagtcatggatttgtggctcagcaccaggtcctgaggggagcgtatcctggcagtgtgggcacctggtggccaagcctcagtttcccccaaatgagcaaaggggataaagaggggcccgacttttgccaccctcctgaggaagcccctaggtccacacagtgatgccatgggggacccttgccttccacacttgcaggtgtcacgttttgcagggaggtgtttgggccttgggctcagccactgggagacagttgggacctgagggacagaggatcggaatggaaaccaccaacgtgcactggcaccctcagaaggcttgtctcacctccaccggcatccacacaaaaccaaacaggagcaggcgtcatccccactattcccatgaatgccatgtcacccctgagcagaagc

SEQ ID NO: 139520 - DNA, 2469 bp, Homo sapiens
cccagacagaggcacttggctgcccagaaggccaggtcagcaggccccatgccctctccccaacaggaggcttcagcagattccaggccgagtgccctcacctgtgtgagaccagccttgctggccgtgccggctccagcatggcgccggtgcccggtccagtgcccgtggtggggttgggcagcctgtgcctgggctccgactgctctgatgcggaatccgaggctgaccgcgactccatgagctgtggcctggattcggagggtgccacacccccaccagtggggctgcgggcatccttccctgtccagatcctgcccaacctctatctgggcagtgcccgggattccgccaatttggagagcctggccaaactgggcatccgctacatcctcaatgtcacccccaacctcccaaacttcttcgagaagaatggtgactttcactacaagcagatccccatctccgaccactggagccagaacctgtcgcggttctttccggaggccattgagttcattggtgagtccaccccacccacccttccctcctgtcctccccaaggcctgctctggcctcccccttgtgagtactcctcccaagccccgctgccattcccagagccaaaagcctaggtgacagttctaggggacaggcagagctagggcggcccccagaggccactagagaaacctgcaggtcgtggccatctggcccagggggcagggcggggcctttgagggcccttcggaaggcctcggcctcacacacgcctgccctccgggtctcccgggccctttcctgccccatctagatgaggccttgtcccagaactgcggggtgctcgtccactgcttggcgggggtcagccgttctgtcaccgtcactgtggcctacctcatgcagaagctccacctctctctcaacgatgcctatgacctggtcaagaggaagaagtctaacatctcccccaacttcaacttcatggggcagttgctggactttgagcgcagcttgcggctggaggagcgccactcgcaggagcagggcagtggggggcaggcatctgcggcctccaacccgccctccttcttcaccacccccaccagtgatggcgccttcgagctggcccccacctagggccccgtggccggcaggccggcccctgccccacccccacccacgggtgtccctgcccactcgtgtggcaagggaggggagggcaggagggctcggcctgagcagggtgctggggggagagcgcaatacctcacgcgggctgccgtcctaatcaacgtgcctatggcgggaccacgctcggagcctgcctcttctgcgactgttactttttctttgcgggatgggggtgggggttccctctccaggtggttgtccaggcccatgtcccggccctgggtgctcagccagctcggctaggccctgcgcctccctgcgcttcccccttcaggaagggtgtgtgccacctcgttgcactggatcccagtggctgcttgggggagaggcgtttgccatcactggtgttgtcacctccctgtttctccaccaagggcttgggcctctcggggctggggcctcccaggggatggggacccagagtgcagtggccgcccacatccatggcctaggagctactgggcaggttcccggccacacatctggtgggctgttttgttttttttttttcctcttcccccagatgtcttgacgggatcactggggctctttgtgagtgagggtggccaaactaccgccggaggagatggggtctcagagcgagagctgcggagggggaggggaagaagaaggcctcacttttgctgctgcggggcccacacagccgctgctactttggggggtggggaaggggccaagctgcagacacacacagtcattcatttctgtccacacccctgtgggtggcgggtgtgcgtgtgtgtgcttgtgtgtgcgcacgtgtcggcgctcacacacacatgctagcccactgatgcacccagcccagggctggcagtctttgcagcgtggggccgtctcaccctggagcctggagaggatctatgcttgtttgtttttgtaatccatatcatagttgctttctttaattgttccttctgaataaacagtttatttaagatactgagtagagagagaagctacctcctgagcgccttggagggtttgggggaaggtggggaaggaggccctcttggtctctctggactgcccatggtggaaaggggcatgtgccaggctggccagggactcaagtgccaccccactccctgccccatgttatcatttcccatcttgtgcttacactgcccgctggcccacgctctgagtcgcccattcattcacctccatttgaacccctagtctgtgccacacactgtcctggggactaggttgcagcagtgagctccgcctgctcacagcagactttctagt

SEQ ID NO: 139521 - DNA, 1087 bp, Homo sapiens
tcacccctacgtggggccttgttgcctgtgggcacccctgctgtgggccccccttcccatcttctctgttgttcacactggactcccacgatacctacttgctgttgttttggtcagatgttgactgagcctctactctgggccaggtgctgggcactgacctgggcctatcagaagaggcgcctgccctccaggaggacgccctctattggaggggtggttttacggggatgataaaaatgatctttgtgggtctgggagcaatgagcaggagtgccagagccagccttacagaagaaaccggcactcgctcagaacagccagctcttccagtccaggcacgtggccagatcgcttcggcttggagcttaagccagctctgggctgccttgacacagggtgcaatatggcctcccgtcagcagggggagccacggccccatctttagacgtccattagcctccctagttccttcagcaccctgggcagcctctcaaatccattcctctccgcgactgcccctaccccacaccctgcaaatcctgccttggggaagtccaaccttgggggagaggtcctgcccatctgtgataggggcgagagggggaacccccaggtcaagcagaggcggcacccctccttcatccctccgagaccgcatatgaggaaggcagtttgggtcacctaggcagtgggatggcagcctgggagagagaaaggactggtttagccaaaggcaaaaggtggtgtgtgtgtgtgaagtgatggcaagggagctgtgctggacactgtgagggcttctcaggctcagggctggtgctgaggctggcagcaagaggaacgggccagaccaagcctggcaggggaaggagctggagctgtagtctaggagcagtggggagccatcgaaggggtttgtagccagagagcatccttgcccagtgtgggttaggtgctgagccggggccggctgctaggaattggggtgtctggaaccagaccagaattgagggtcaggggaaccctggtgggcatcacaaaaggaagctgtctctgctgttctgggccacacagggtgggtcacgtg

SEQ ID NO: 139522 - DNA, 2320 bp, Homo sapiens
gtcccggcctccagcttccagggtagccgggaagctgtagcccccagtgggcagcggtggagagagctcaaggaaggagggagcaccgggaggagacggctgcagcctgccaggagcggggagaaagggagagaaggggaggcggagggctgagggggcccgggggacgtcttcccagggctgggaggggccggccgggaagcctgggctgcactaggagccggcgaccctggggcgaggggcggcccggagccctgcgggaggagctggcggccgccccaggtagcaaccatcctgcctcccgctggagcggcgtctcctccccgggaggagggcagggaggaggtgggcggagtgtgacgaggagggcgggagggagggatgcgggagggggagggggaggggggccggccggccgtgggggtggggcgatagtgacatcaccccggagtcggtttttaagcggcggccggccggggacggggaagagagggatagtcggagcgaggtggcgagtcgctgagcccgccgcggccccgagagcggctgcagccgccgccgccgggaaggagagggcgaggcgcgcccgagccgccgccgccgccgccaccgccgccgccgccaccaccgccaccggagtcgcgggccagccgggcagcctccgcgggccccggccggggcggggggcgcgggccacaggcccctgctccggccgccgcttgcagaccgcgggcgccgatgtcgcccgcgccccgctaggctgagcctcgggtcgggcgaggagccgccgcagccgccgccgcccgagccgcgggcaggagcctcgggagccgccgccgccgccgccgccgcccggccgggccccgccgccgcccgcgcgcccccgggcccccgacacacatgagattcttcaggctcactttcaagtgcttcgtggactgcttctgactgcgccgcccgcgccccgcaccccgccgcccgcccgccgccccgtcccccggcccggccgccccccggcccccggccggcccgcgccctcggggccctccccggtgccgccggtgccccccgcctgaccgccgccccccgtgaggcgccgcgaccccggcccggccgtgcggcccgccgaggccatggcgaagaagagcgccgagaacggcatctatagcgtgtccggcgacgagaagaagggccccctcatcgcgcccgggcccgacggggccccggccaagggcgacggccccgtgggcctggggacacccggcggccgcctggccgtgccgccgcgcgagacctggacgcgccagatggacttcatcatgtcgtgcgtgggcttcgccgtgggcttgggcaacgtgtggcgcttcccctacctgtgctacaagaacggcggaggtgagttcccccgcccgccgcggcctcctcccccagcaggccgccggcccccgcccgacccccggagccgccgcggaggggtgaagtccgggcaacgggtggcccccgggcacgcgggggtcggggccgcccctcgtccgccgctgccgctcggtggccgggccgggcgcctccacccccctcgcagtcatgtgcctggcatggtggggggagggggccggcgatgcccgcgaggctgccccccagactcccgggctgggaggagcgattggccgccgaggtgggaaagcaggcctgcgccttggggtctccgcgaggtaaggagccctggctgcccccacgggtcgggcacacaagcggcacattgtgtgggccccccacgtgtgcacacacacgaacacacacacacacaatgggccactctgtccctccccctgccctcccctcccctcgcggccctcccgcccctcccctctggcccgggcctggaacactgggtgcccgagccaggcttgggaagcctgcggcctggcccgcctggcgccgccactggacacactgcatgcacgtcccatgcccgcccgcccgcccgcccgcccgggcccagcttagcaacagcgatgggcacgcgtgtgtcctgtgactacaaaacagcactggggttgctggaagccgaagtgacccggtgatgggtgggaaacagaggtccagagcaaaggcctttgcccaaggtcaggagaaggatgctgggacctggagtcaggcaagttgcagccaagctcagcctctgagtagtggagcgagcccagccagggcaagggtaggaggcccagagaggagaagggggtagtggcacccagctctccctgcccttctgccacccccaccccagcctgctggcctcaggagataggcctgtgtcacg

SEQ ID NO: 139523 - DNA, 3791 bp, Homo sapiens
gctaaggccggcctggcccctcttccgcacctgtatccctctgtccttgcacatcgccatcccaccagcaggggactgtgacccacccaccctctgccttagacctcacacttgcaggcaagcgtccaagggcaggacagtcgcgctccctgcctttggatgagccccccaggcctgatcacccagccttggcacacatgcacacatgcacgtgccctcactgtgctgcctgaaacagggaattgcagcactagggacagcccgcgtgtctgagcgtgtgtgtcctccatggccatcgccccaagtgaccgtgggggtggaagccctgggggcctagggcccctctgccacccagggaatagggctccaatggctcaggggctactgtagcccctcttcaacacactcaacccaccccctcaagactccacctggggcctgagtcagtggccacccctacactgactcacccagtcggaagttgtgatggggcctttggagtctgggctggcccgctgggcctgggcagcctggctgggggccaccctgagtccacgctgtgcctccacccccaggtgtgttccttattccctacgtcctgatcgccctggttggaggaatccccattttcttcttagagatctcgctgggccagttcatgaaggccggcagcatcaatgtctggaacatctgtcccctgttcaaaggtgagcagcccttggccagcctcagggactgcccccttctcccagctggctcccacttgagaaatcttttcctgtcgtgagcaccaggcctggggccacgtgatggcgtcccagtctcgaggggggagcctggaggagatgttcaggccgcacagcgaacttggggaagcggggactagagggggcataggcagctccacaaggcaaggacaggccaggcatagccgggctggggacgggacctgcccagcagcacccttggctctctaggtaggtcctactgttactatccccaaggacgctggggcacagacaggtggagcgacgtactgaggttgcccactgcaggggcgactgtctccaacactacctcaggcgactagaaaccccccccccccaccaccaccatcaacaccagctgctgaggactggaggctactgggtggccaggcagaggcttggacctcctggaaccgccatggtggcagtgggacccacagaaggggccaggtgtatgaggctggagactccacagcacttggtcagatggggacaggaggagaggggctcgctctgccttgggtctagggggcggctggaggagaggagacaggctggggagtcagcgcagtgttggggctcacacaagggggagcccaggggagtcaggagcaccacaaacaaggctccaggaggacagatggtgggagcacggccagcctgggtggggacataaaggggtggcagggggaggtggccagggaagaatctacatggcaaggacttcccggccccaggcctgggctacgcctccatggtgatcgtcttctactgcaacacctactacatcatggtgctggcctggggcttctattacctggtcaagtcctttaccaccacgctgccctgggccacatgtggccacacctggaacactcccgactgcgtggagatcttccgccatgaagactgtgccaatgccagcctggccaacctcacctgtgaccagcttgctgaccgccggtcccctgtcatcgagttctgggagtgagtccggcacctctgggccaagcccatcccatcccccaggtctccctcatgttgcccggctccaggggagtggccctgagggggcaccagggtgttgcctggcagtccatcctggaccctgcctgcccttgcctgtcctcggagagtcctggggccagcctcgctcctgggttcggcagccgatcactgtcctggtcactcccccctgatgggggagctggggctgcatgtgaggtgggatgggagtggcctcccaatggccaggggatcgtgggctccaggcccagcccaattggacaagagggacccgctgaaccctgggctgtgggagagaagggagccacaactcctgggggtggaccctgtggctccatcctctgctggcacaggcctcatgggacctccctccctcccctaggaacaaagtcttgaggctgtctgggggactggaggtgccaggggccctcaactgggaggtgaccctttgtctgctggcctgctgggtgctggtctacttctgtgtctggaagggggtcaaatccacgggaaaggtaccactagaggcatgcagcggggagggtggctcagccctgggagccggatgtctgtgccaggcacacctgtggcaacgggaggtgaccagacagagtctagccctaaggaagggggaggtactgaaagccaagcaatgctccccaccctgcaaatccagggcccagcagcctttgctcctggggatagaggccctggcaggcactgtcccttccctgtgcccatcacccccactggtgccctcctgccagtctctgactcttgtgacagtctggtggacctggtctggccatctgttacctatcttgccttggggacccagagcagagtctggccacatcccttgggggctcctggtcaggctggggagtcacctgaacaaagaagacagtgtctagagctgtgggacatggccagctccctgggggacaaggtccccagagcagcatgtgggaagagggggcagacagtgtggcagctgcatctcgcctgcctctgcctggcccagttccactctccacctgctcaacccccacctctctccagaagaggagggggacccgacccggatccaatatcccgctccctgcctgggcctcccacacctgcactgcccacacactcatacagctctcactccccacgtgctccacgcctcctgtccccactgaggagagctcccagaggctcgcctgctccccaccgacacgcgtccctgcagacaaacgaggcgcccagggagcttccccactgcacttggccagggctgccggggcgcagccttgcccctagcttcctctggcgggagccatggctcggaggacaatggggacctctgaacatacctgcccgcaagggggaccggaggcgctgggagtgggggtgtgagggaggtggtgccacagcctccgctgagcagcctggccccccagatcgtgtacttcactgctacattcccctacgtggtcctggtcgtgctgctggtgcgtggagtgctgctgcctggcgccctggatggcatcatttactatctcaagcctgactggtcaaagctggggtcccctcaggtgaggtggaggtggagaggctgcagcagggcgctgcgggggagccctgcaggcccctcatgcctgcgctctccggcccttctctaggtgtggatagatgcggggacccagattttcttttcttacgccattggcctgggggccctcacagccctgggcagctacaaccgcttcaacaacaactgctacaagtaagcaccgccgccctgccacccgtgccctgtcctgccctgccccgccctgcccagcagcctaacccatccactctggcccctccacccctcagggacgccatcatcctggctctcatcaacagtgggaccagcttctttgctggcttcgtggtcttctccatcctgggcttcatggctgcagagcagggcgtgcacatctccaaggtggcagagtcaggtag

SEQ ID NO: 139524 - DNA, 3953 bp, Homo sapiens
ttcaaacggaacttgtcagattgtgggcctgtgggggcaggtcctgggatttgtcaatgttgacagagaaaggacctcccagcccctgccgcacgacccagggttgacagcgcctctgaggcaggcgtgggcatgggcgcgagtgttgcaggcagggctcagggtgcgcacagggcaggacatcggctacaaggtctagagcctgcacctttcccacagggccgggcctggccttcatcgcctacccgcgggctgtcacgctgatgccagtggccccactctgggctgccctgttcttcttcatgctgttgctgcttggtctcgacagccaggtttgcatggggctctgggacagggagccaggaggggggcggagggagggctgcaggcaaggaaaggggtggagggcggtgcggggctcggcctgagctgccctggccacagtttgtaggtgtggagggcttcatcaccggcctcctcgacctcctcccggcctcctactacttccgtttccaaagggagatctctgtggccctctgttgtgccctctgctttgtcatcgatctctccatggtgactgatgtgagtggggtggggggtctgcctgtgacctctggtggccgtctgccatcctccctgactgggctctgtcccccagggcgggatgtacgtcttccagctgtttgactactactcggccagcggcaccaccctgctctggcaggccttttgggagtgcgtggtggtggcctgggtgtacggtaggtcatggctgagggctgggctgggggatggtggcggggaaggcaggtctccagcttggccctcccgcctcacctcgccgcaggagctgaccgcttcatggacgacattgcctgtatgatcgggtaccgaccttgcccctggatgaaatggtgctggtccttcttcaccccgctggtctgcatggtaagggctgggggaggtggggcagggcggggggcgaggcagggcggggtaggggccccattaaccgcagcattctggtccgtagggcatcttcatcttcaacgttgtgtactacgagccgctggtctacaacaacacctacgtgtacccgtggtggggtgaggccatgggctgggccttcgccctgtcctccatgctgtgcgtgccgctgcacctcctgggctgcctcctcagggccaagggcaccatggctgaggtaaggctcccgcccggcccgccctcccctcccctgctgtgaacattcaacccagcctgcttcctagccagggagtggccccgactagggtggcaggcagtgggaaccggagagaggcagaggaagtcaccgtggggacgagcaggtgaccctgggggcttcagcatgtcctcctctcctgcagcgctggcagcacctgacccagcccatctggggcctccaccacttggagtaccgagctcaggacgcagatgtcaggggcctgaccaccctgaccccagtgtccgagagcagcaaggtcgtcgtggtggagagtgtcatgtgacaactcagctcacatcaccagctcacctctggtagccatagcagcccctgcttcagccccaccgcacccctccagggggcctgcctttccctgacacttttggggtctgcctgggggaggaggggagaaagcaccatgagtgctcactaaaacaactttttccatttttaataaaacgccaaaaatatcacaacccaccaaaaatagatgcctctccccctccagccctagccgagctggtcctaggccccgcctagtgccccacccccacccacagtgctgcactcctcctgcccctgccacgcccaccccctgcccacctctccaggctctgctctgcagcacacccgtgggtgacccctcaccccagaagcagcagtggcagcttgggaaatgtgaggaagggaaggagggagagacgggagggaggagagagaggagaagggaggcaggggaggggcagcagaaccaaggcaaatatttcagctgggctatacccctctccccatccctgttatagaagcttagagagccagccagcaatggaaccttctggttcctgcgccaatcgccaccagtatcaattgtgtgagcttgggtgcgagtgcacgcgtgcgtgagtacggagagtatatatagatctctatctcttagcaaaggtgaatgccagatgtaaatggcgcctctgggcaaaggaggcttgtattttgcacattttataaaaacttgagagaatgagatttctgcttgtatatttctaaaaagaggaaggagcccaaaccatcctctccttaccactcccatccctgtgagccctaccttacccctctgcccctagccaaggagtgtgaatttatagatctaactttcataggcaaaacaaaagcttcgagctgttgcgtgtgtgagtctgttgtgtggatgtgcgtgtgtggtccccagccccagactggattggaaaagtgcatggtgggggcctcggggctgtccccacgctgtccctttgccacaagtctgtggggcaagaggctgcaatattccgtcctgggtgtctgggctgctaacctggcctgctcaggcttcccaccctgtgcggggcacacccccaggaagggaccctggacacggctcccacgtccaggcttaaggtggatgcacttcccgcacctccagtcttctgtgtagcagctttaacccacgtttgtctgtcacgtccagtcccgagacggctgagtgaccccaagaaaggcttccccgacacccagacagaggctgcagggctggggctgggtgagggtggcgggcctgcggggacattctactgtgctaaaaagccactgcagacatagcaataaaaacatgtcattttccaaagcaggctcctgcttccgcctctgctgctctaaggaaggggtcggggtacaggaggcagggggaacctcctccagctggagctgctgccgtgagcaaggctctgctctggaggcctctgcggccggcacccttctggggactgggaagggggcagggaaggcagcagcccaggggaaggccttgtccccctggagccgaggcagttggggagagcaggacgagagtgagctggagagcagccacacccgcggggaagggtgggcgtaaagccatgggtgctgaaattttcaaaatgttaccccaagaatttgtcactgaacaggtgccttgtgtcacttgggccaggctggtagcagcagaggggataactctgcatcagggatcaattttgaaggtggagccaataggggttgtgcatgaccaggatgcagggctcaaagaggagttaaggacaacagatttggcctgagcaagaggaaagatggagctgccaggtcctgcaatggggaggcaaggagagaatggtctggagtcagccttgggtgtgtcatgcaggaagtgtcatccaagtggagatgtctagttggcaggtggacacaggagttccagaaagtactggagatggaactgtgcaagttcttaccacatagagatgacactgaaagccctgagcctgagtgagctcacagggacgccgcaagccccggaacacaatgagaggggcagagcgaagacgtggcagtgataggggaggacgcctgagagttcctggtggggtcctgcaacctgagccagtgaggacccctcacaggtcagggaggagcagtggctggctccatctgtccagtgctgctgctggtgaaggacagtgacctgcaaatgctcactgagtctggcaagggtcacgggggcctggcgagggtggcttgcatgagcgggtgcgtgtgaaaggctgggtggtgtgcgactgagaaaaggagtggcggcagcgcagtgtcatctgcagacgaagggagagacaacaacgtagttcacccagacaaggaaata

SEQ ID NO: 139525 - DNA, 1324 bp, Homo sapiens
agtgagggccacataaatactcctaactttggacagctggcctcagtgcttggtggcccaagtttgggcaccacagcaggtggggaggaagggtccagcctcaaagggggcacccatgccctctgtatggggcaggcttggcagatgggcttcgagggcacctgtcaaaggtgtgcagagttgggaagggtctgatcaggtcttgaaggggactggatgccttgctgttccctgcagccaggactcagcccccagtgaggtcctggcagtcctccctggctggcgttaggtccagggctttccctagagcgtgggccagggctgacgctcccaccctggcaggcctttgggtgcagctggggagggggccccttgttcacttgaatagctgttgttaggagagaggggaaccgaggtggacctctggggcatggggctggaggtggcaggggaggagtggacccggccaacctactgctgtgggatttctgtccctttccaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgtacgtggtgcggtgtgtgactgcagctgtggggagggctctgctttctctcctgcctggagcccccaagcggccacagcccttcaacctgtttcccccactgaaggccaggctcacacctgttctcgaaggccttgccctctctgtcctcctgctccccgggctgggccaggcctcgcttcagggccacccgccgagtgtgtgtcctgtctgcctccctgggtgtgggcagcttgggaggctcagtaaaccggcggggcttccgggtagaggactcgcttgccttctctgggttcctgttcgtcacatttgggacagacagaacgtggcagaacgccactagtca

SEQ ID NO: 139526 - DNA, 1096 bp, Homo sapiens
gtagttggccagtcttagacgtcccgtcaggaggtgagctgcaaggcaagctcggagggatgtggatgcagaggtgggatagagctggccaggccgactgggggctcctaactgcagtgagcggcaccatgtagggagcacgaggcaccgccatctgtggaggggttggtgagcaccatggagctgctgagccctgctgcttgggaaggaggcagggccaggggccaggggccaggggccagggcaggcaaggcgtgcccggcgagctgcagcaggtggccccgctggcgcttctctttccctcggcgggcagccacgccctggcctttgcctaggagctgggagcaagtggtggctcggttccgcgttgacatttccgaaggggcgtgtggccagggcagcttgaggaaccgcagctcggtggggaggatggggctggaacctctccctccctccctcctgagtaaccctggcctttggcacttttcccagggagctgctgttgacggaggcaagttggatgtcgggaatgctgaggtgaagttggaggaagagaacaggagcctgaaggctgacctgcagaagctaaaggacgagctggccagcactaagcaaagtgaggctcgacctcgtgtccttccccgcagggaagtccagaggagcctcctctgcccgctgctgcccattttgtgccaaagtattagtaacaagccttgcacgcacgctcgagggctggctgaaaacagaccaatagcaccctgcgcctccaaccccaatgcagccatgcttagccggcaggccagtgaggctaagtggtttgaatggggctcaggaggaaccaggctgcagttggtgggcctcgattgccctgcactagagcagtgcatgctggggctttcccgtccagagtgtggcacggtagccccagcatgcctgggggctgagaatgaggggagtgtgggagtggcgttcaggaggggagtgggcggctcccaagcggcctgcctgtctttggtctcccacgcatagacttaagtctggggcgttttcccccaataccacaggcctcgcctgctgctgctgtgtgcaaggcgtg

SEQ ID NO: 139527 - DNA, 3009 bp, Homo sapiens
accggctttctgccggctgggggctgaggagtgagcttatgtgaacaccatgtgtatgcaggggctgggggttgaatgacttgactcgcctgaaacccgtcagcagggcgggccgggggtggccacagcatggaatcttttggtcgggacttgctccttctccatttcctattaagcccgtgtcctcttccccttgctcatgggggaagacagggctgctgaaaagtgcttatgagccatggctctctccatttgatatggttggccctgtttctctagtctgtggagaggttctgtttctcctgccttctctggtttactcaaccttttataaaagcacgatagccctgctcagtgtccaacaacattctatcaagaaagcccagtcagattgaggcattggggctgccatgtgtcttccaaggccacatctggattctgttaagtttcgttcactggcctttttttggaccccaggccattctattggtgaccaccctgtatctgtaggagttgcctttggctcttaggttctttcctgttttctggaaatgaatagctaagaacagtgattcgggtaagactacttgggagatccagcagaggcagaagctaaaggccatgttcgtgccctgtcctgggggcctgggaagctacaagggaacagacaagcgcacgttaacgtgcctgagtgacccagtgtgagggagcgggaaaatgttctagaaggctggctcccaggctgaaaaatgccagtgatcagagaggacctggtctgcattgcttgggccctgggtgggggttgagggtgtgaggatgcagaggctggagctctgggttgtgccttcaggtcgcggcagtgaatgttttttccccctgcagccatgagcctggcttgcccatcagaacgggtctgagacggcgccttcccactcctgtcttctgtctcctctgttgctagactgagcagctctgtgtctgcctctgcccctcttggtgccaggctcccaggtgaacacaggtgcagtctaggcccagggagattctgtccagccttacgtgcagcctcaaatctgtcccctcacctgtcagggagcatttcctctcctgggagtgggatccagtcatctggaagcccagccccgcgccctccccccctttttttttttagctatacttgctggagtgggcggaagaccccttttcagtgtgccaggtatgggagtgcagagatgaaggcacagtgcccagcctaaagaccttcatagcctggtagggcagccatataaacggatggcagccacgcagagaacagagaatgaggtagttacatgcgggtgcctggggggctgctgcaggagcccccagaaggcgtccctctgatggggtgggagatccaaaagggtttctggggggaggtgaggattgagctgggtcgagaggacattccggcctggagaactgccacacagagccaggcgtgttccaggaatggtgaggggttaggtgttactagagcagggggccacgtggttagtgaaggaggagagctcactgagggcatgcgtgctggcagcaggtggcttaagcagagggctgacatggtcggatttgccttgctctgggaggtggatgggaaagccgtatggcagcagatagggaggaggcgccagcagtggggatgatggtgggcatgtttgcagttgacatggaaagtgctgggttgtggcttgggctgggggccaagagggctgagtccaaggcggtttgcctgcccaccactacagcaggggctacacgaggtggtcaggtcaggcaggacaagggaaggcccgttttggacaagctgagtctagaatgtctctggggacatccaggagccaatgtttagcaggaggttaggtatgagtctgggccacagagaaaaccctttcggggataagagtggctgggaggaaggtatagggtgtcagctgaagagtgcagaccccagagggagcagaataacagtgggaggagggtgttgcgaggggacctcaggagggtaacttagcagcagagcaaggagttcagggtgacctccggcctgggcggttaggaggccactggtggccctgctgctggcttggaagggcaggccttggccagcctaggttgaggaatatatgggagggaaaagaccaggggcttgggcagggtgactccaggaaggaggcagttgaaggtgaggttcctggggggagaatgatcccgggtcatccagcaggaagagagaggacctagaaggtgtgaaaaagaactatcgggctgggggtgcagtgggaggagtatgcccggggtgctgtgggggtggggagcgcctgtgagggttggcaagaggaaggggaaccggggcctggcagaggggagccccagactgtctcaaggctgggaactgaaggcctgggctggggctgagcagggccaggctttcggacacacacagcgtggatcttgcgctggactttgtgtatgccctggcctatcttggaagccctggttctcaatagccgggaagggcctgggacggtccgaaaagagctgggcctctgctgcactgccgcggaagcatttgtgttagctatctccctgggtactggggtgacagccatgggcactcaccagcagccgcttgcctggcctggtggcggggagtatagccttcagtcttgcttggtcctctctctaccaccaggtggcatgacccccacccctcaattccagctgggaggagcggtcctcttcctctttctacatcactgggatccgctctggggctgggcagctccttgccgggggcctgggtcttagtcagacttgcctttctttctaggcctctccattgacttctggccatgccgatgtgagtcagatgcattgtttctctctggctcctagggcgctcagtagcttcctccaccttcaggctgtagcccagtgcggggcaggctggtgggcagctgggggctg

SEQ ID NO: 139528 - DNA, 2460 bp, Homo sapiens
ttttttttttttttgagatggagtttcgctcttgtcccccggtctggagtgcagtggctcaatttcggctcactgcaacctccgcctcccgggttcaaatgattcttttgcctcagcctcccgagtagctgggattacaggcgcccaccaccacgccgggctaaattttttttttttgtatttttagtagagatggggttttgccatgttggccaggcttgtctcgaactcctgacctcaggtgatctgcccgcctctgcctcccaaagtgctgagattataggcgtgagccactgcacctggcctgagggtgggagcttctgataacagcatcccatgaggggtgtatgtgcatagaagtgggaagaactggggaggcggatttgagggaagtgagtctgacctgtctcatgccgcctgtctgcctggtatggccttatcttgccctagtgtccgctaaatgcccgtgtctcctctctgctccaccacagatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttgtgagtggggggttgagggggcaggtgctgtgaaaggagccatgggctagccatggacaccgagctcagtgggctcagtctcccccctgtgactttgattcctcctcagtctgtggcctggatcccaaagccctgtctgtgttagggaagccacatagttttctcctgacctccagaggcagcgtggagagtaggagagggctgcctgaaatatcagaagaccctcacacaccacatactctcaggcaaacagatgactatctcacggtctgtttgcatggagagtgagatgtaacggtaaggccttgccctcctctgggagaggaccttcagagtccagctcacaagggagcgactgaatgggggactctttgtgtccggggtgttgacctagggacagcaggtaaaagtggcacgaagaggctgggcctctcctcacctcagggccttccccacgtgaaactcgtaatgaggacatgttacattccatggcagccagagtatttctgatgatttttttggtaaaactaagtaccttaatcaaggctaagggtaactagtcgggcaaaactagaccactacgaagtgcctatttgagcctggggccctgtttgctgcctcctgcttcacatagccgttctgatcagcagggcctggctgggaggtggatgggagctcagaccatgtatgaaggcattggaaaggcgcttgctttgagggtggagctctcatcacttaatcacttctcaaaagaccccacctcttaatgctacggcagtgaggattaaattccaacacatgaagtttgaagggcactcagaccatagcaccaagtgattctcaggctcatggacagttattccccacttggttttgtgccccgagactcaagaatctccatgcctaggagattcttgctctctagtcacctggtgtgtcctgctttactaggcgctacgatgactacttgtcttaaaatctgttgtttagatgatctggtactctctgcgaccaagttggaaagaggggtggagctagaaaaggcaaacacatttttttcaagataatgggtttgatcacagatttgatctacaagcttgctgtcttcaaacttaggaaagtcaggaaggctgggaggagtcagacacataccctaaatttttcaggaagttccaaacaagtattatcttgtggtctgaggctgaaagggaagcagatctgaaagactgagtctcaaacccagaattctgagtgtgacagtcagcaaaatgaggaaaaaagaccacattgagagggaaagagaggaaactaggccatctaccagaaaagcatctagagctttaagaatggtatgggggaggggtgggctgggtgcggtgacttaggcctgtaatcccagcactttgggaggccgaggcaggtggatcacctgaggtcaggagttcgagaccagcctggccaacatggtgacacccagtctctactaacaatacaaaaaaattagctgggcttggtggtaggtgcctgtagtgccagctactcgggaggctgaggcaggagaattgcttgaacccgggaggcagaggttgcagtgagccgagatcacaccactgcactccagcctgggtgacatctcaaaaaaaaaaaaaaaaaaaaaaaagaatagtatcgggaaggtgaaaacctgccgggagctctgaatcatgaaagacatggagaagtgaggagaaggcagtcccttttatatgtctgtgtaaggaaggagatggagggtaggtggtcaagggcaaaggaaacactaggatgagaaaatggaaatta

SEQ ID NO: 139529 - DNA, 1066 bp, Homo sapiens
cctagacctctctgcatctgggctagacttgaggttttcccaggtcgttccagctctgtagttctgtaaactctgacattgaggtgtacactagcaggtgcttgaaagataaactggtccaagggcaagcaggctctgggataaggccaggccaggtggtggtaagatgaaaggcagacattttgcaatgaggtggtagggtgaccatctggagacaagaatcaataaagctcttgtctgactggtagatgtttgttgttttgctgtggtaagtgatcgatatgtccccctgtttgggctccaaagtattggcttggctctgctgtggacaccactcttgtctcagagctgtggtgcctgcctaggcgtggaacactcctcccaccgagtcccagcagaaacactgagcgggtggggggctgtggttcaggggaatgtgcaaagcctcacccaccagcttcagcattaggcatttctccttcctgatgtctcagagcctgataggatatgttcaggctggactgcctctgaacaggccaagtgttacctgacagcttccaaccacatagggtaggtgccagctgcctgagcacctcagtgttcttgaaatacttggcaaggccccaagaggtagtagctctttctaaccagggttctcgccctgagcagcctccaagccaggagtaggtaggtaatatatgtgtcatccccaggccactgagtttttgaactgagcatgtgtgttttggcttttgggtctggggtgggggtaataactggggaggggagggaccatgctgaggatgattccctcagggtcttgccccttccccaaaccagaaggagtatgtttctttcctagagcagctgagtgggctggagagatcctttgcggaatccagtagttgacaaagccttcattcttttttgggatcggggaactgcttggaagttctagggggacatatggccatgatgactggctgcttcctactcccatgttaagaagcataatctagaaagatctgcagagccttcttcaaacagaagtgttagtcacaggtac

SEQ ID NO: 139530 - DNA, 1080 bp, Homo sapiens
ctttttttttttttttttttgagacaaggtctcgctctgtcacccaggctggagtgcagtggcgcgatctcggctcactgcaacttccgcctcccaggttcaagtgattctcctgcctcaccctcctgagtagctgggattacaggtgcccaccaccacgcctggctaattttcgtacttttagtagagacagggtttcgccatgttggccagtttggtcttgcactcctgacctcaagtgatccacccaccttggtctcccaaagtgctgagattacaggtgtgagccattgcacctggccttttttccaatagtcttgaatggatgtcaaattagagaattgcaagccactgaggctgactttgcatgggctattcggccattggagaagagtacaaagctggatttccattttgctcagggccctagagctcgtgtgtgtgctttctcttcaactcctgtcctttttgtcttcttcacagatggcagaagattttcaagtcccggctggtggagttgttagtgtcctatggcaacaccttctttgtggttctcattgtcatccttgtgctgttggtcatcggtgagtgagctatggctgagggcagctacctgacctagaccctggtctctgctgcaaaaccctttgccacttttgatgtgtagcatccagttttggctgctaggagacagaccaatgaaatgctgtgtctttctcttgagggagggaagaggctccctttgcccatgctgctgaccgctagtcggttcttcactttgaggcccctctaggccgtacatggtggctcatgcctgtaatcccagcactttgggaggctgaggtcggtggatcacctgagatgaggagttcgagatcagcctggccaacgtggtgaaaccccatctctacgaaaaatacaaaattagctgggcgtggtggcgggcacctgtaatcccagctacttgggagactgaggcaggagaattgcttgaacccacgaggcagaggttgcagtgagcctaaatcgcaccattgcactccagcctgggcaacaagagggagactccatctcaaaaaa

SEQ ID NO: 139531 - DNA, 1343 bp, Homo sapiens
agcgcttggactaggtgcggccttgggcctgcctggtagcggggatttgggcccgcagagcgcccgcctctgcggctgagttctgcctggcggggaagggagcgcccgatgggtgccgaggcgtcctcctcttggtgccctggcactgctcttcccgaagaacgcctttcagttaaacgggcgtcggaaatctcgggcttcctggggcagggatcgtcgggagaggccgctctggacgtgttgacacacgtgctggagggggcaggtaattgaccagcgaacggaagtttgtggggcctgtgaacgctgctggccaagaggccctgccgagtggagccctgcttccgccagcgcatcagagactttgaagcaaagtgcagggggtcagggtggagagtggcggccccagcctcgcagggtaactgaactggatgttcttggctgcccagcgcttacaagtcccgtaccttttgtgccctgccaggaaacaagctcacatcttcctgtgggaaaccttctagcaacaggatgagtctgcagtggactgcagttgccaccttcctctatgcggaggtctttgttgtgttgcttctctgcattcccttcatttctcctaaaaggtatggcctatggagcaagcaggcgagttaggcaggagggtgcctgtgccctagccctgggactggtgtgtgcagctggtggaccctggaattgggacccgatggaacaggtagaacctgtctggggtgggggtggcaggggttgtgtttgttattgccaacccttcccagggttctgcttcgtcatgacttgctcagttccttttcctgtgtcccctgccttctggtcttcagaatgcccccgagaggcaggaagatctatgttacagttctggaaatgatgccctcccacccactcttggtccacggggtgctgggatggtagcgtgggattcggaagacttgcaccactgggtcacgttgttgctgatttggtgactcttgtcctcctaactagtctcactggtattgcgcagtggctgcatgaacattactcagcctgtggaggatgaagccatattcccttttaatgaacagaggacctgttaaaagtgaattggagattaattttaattatgtataatacctgaacacatccctatttaaattacgatattacaaataaggccaaatctccacaggtatttttaaaagccgttttttcgtgaaaaattatctttgatgtgataccatagaaagtatgcagtgctgtctgaggaggattcttgtagaaaaccacaccttcgtacagttgacaagacgtgcagagatagagggccccgg

SEQ ID NO: 139532 - DNA, 1021 bp, Homo sapiens
agtgactcctccaccggcccagaatccccacccactcttccccaggggcgagtcgggggaaggggaggaggcggaggaggggcgaggggcggagtccgggcgcgggagccccaccctgttctcgcccctcggcggggcccgcccacacccccacctcccgttctcgcccctcggcggggcccctcccgcaccacagagacgtgggacggccgcgcggactagagaagcggccctcgccggcccgacaaagccccgccccgccccgcccgcgtgctcgctccaccccgccctgctcgcccggagcccgaggcgcctcttcctctcccgctcggagcgccggccctccgctccggggcggggtgggaagcggaggtgggcggagcctccggggcctcgcgagggctggtgggcggtgcccggcgggcgcttccggtttccggccgcggtatgaggggcggggccggggctgctgtgggagagttctgttgctgcggcggggcctgcacgttgactgtgggaaactcggtgagcgggctccgcgcgccgggctgggctccgggaccgcggaggctccccggcccatcgacgagggagagaggcgagcggcgcggggaggcccgggggccggggaatctcggggcccgcagcctacctgcgtgtgagaggcaggggcgaggggaaaccgggcggcgcctctagaagctggtctcgggggcggggcggggggcggtgaagccccacctggaggagcggccgggatgggcctccgggacggtgtgccaggccggggccaagtcggaggcccctcgctctgggtgggcgctggggcccgcgagggctactgtaaggacccctggcttctgaggatactgcgtctagaactttctccgtatggggccttgaggtgcttggtcgagacctgcctttgcgcttggtcccgaatcctgccctctaggagtcgctcttgcgggcctccagcccaccggaggcgaagcggccccgggcggaaggccgctggatc

SEQ ID NO: 139533 - DNA, 1026 bp, Homo sapiens
gaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggggcaggttggggtgccgggcacggagggaagcgtgtggcagggaggcccgggggcaggcagccgtgagcggtggggacagtctggggcgggccggggctgatgccaaaggtgtgggcaggccatgggagagccgggctggggtgggcagggcctttgggcagccgt

SEQ ID NO: 139534 - DNA, 1051 bp, Homo sapiens
tgcatttgatttttagtccattagtggtcaccctttaaaaggtcaacacgcagccgggcgcgggggctcccgcctggcatcccagcactttgggagggtgaggcgggcagatcacgaggtcaggaggtcgagaccatcctggctaacagggtgaaaccccatctctactaaaaatacaaaaatttagccgggcgcggtggcgggcgcctatagtcccagctactcgggacgctgaggcagaagaatggcgtgaacccgggaggcggagctggcagtgagcccagatagcgccactgcactccagcctgggcgaaagaacgagacttcgtctcaaataaaaataaaaataaaaaataaaagatcaacacgcatacttgttaggttaatcaatagctccgccttctcctggaccttagaacgcagaagcagccccgtggggcatggcatcatagcccagccaagagttggatttgtacctagtttttcctctttgctatcgccttatccacacgtgttgaaactcactcgcatgtttgctgagttctgtgctcaccatttcgttcctacatctcaatttctcttctatgttctgttatcttcctccagatagacatgtttttagttttttgtttgtttgttttttaactcacaactatgctcaggacaaacagtcatcagtgcttctagttgtggttggtttttaaaaaaggttctttcagcaagggttttgtcatgggaaattcttgattattttattgtaattctttgtgttgtttagttttttgtttgtttgtttgttttttgtagaggcaggttctcgctgtgttgcccaggctagtgtggaactcctgggctcaagcggtcctcccgcattagcctctcaaagtgctgggattacagacgtgagccaccacacccaggctgttgtcattcttgattatttttgttgaaaatgtttctatttcacccttattcccaagctaaagttgagttgcgcaatggagtctaggtggactgttcttttctctcagccctttcacaatgtctcatt

SEQ ID NO: 139535 - DNA, 1120 bp, Homo sapiens
ggcctaggtgacctgggccctagatcttcctgtaagttccagaaaccccaggtgggcgcatccaccctgggaatgtcctggtctctctgggactcagtggaccatatgcacagcaggggtggggcagcaggaaaggcacctgttggtcttccagatgtgcagggtccctgggtcctcgatgccgtgcttctctgctagctcatccagaaggtcaaacaggtacttgacggcgatggggatgggccggttcacgctgagaatggcctggaaggtgtcgtccacaaacttctgcagcgtgccctgcgaggcaggggataagggctgtgtggagggcagggtgtgggggccatccacggctgaggctgcccctgcccctcccacaccctggctcggtcggggtccctggctgagcctcctctcaggcccagccacccaggccgcaccaaccttcatggacagcagacgggtgaggtagatttccggaatggccttggcccttgctggctcgcgctcccgcaggctgctgcaccgcaccttggccccttctggctcctcggtggctttcaccaggtgccagaggcacacccccccctcctcgccatcctccagcgtgggtatgtctgagggcacaggagcctggcttcagggctataccccctgcccctggcctgggatgcccagtccactcccccgacaaggtggggcagtgtggggactggaagaaaggaaggagatgggcagaagatctcggtggggtgggggatgaagttgaggcagatgcatggccaggagttctgcctgcccagcctggactccagtggccccaggtcagggccgagggactcactctctcccaaggggcacctctgggccaggctctgggagatggtgctgccacggtgcagctgagggacgagccccactgttgctccatctgggacctggcagagatggggagcggaggctgtgctgacccctagccaggcgcctacaccgcccacatcctgccctgcctcgcccttccccgccccagacccgccctgccctgcctcgcctcaccctgccccaccccatccctgcccttccctgccttgcctcgccccgccccgccccccatccc

SEQ ID NO: 139536 - DNA, 1098 bp, Homo sapiens
ggacaatggtctctcttttggggtcactggggtcgctgtcccggacctggagcaaaagccaaggggccacagatggttccaccctgccctgaagcccacagctcccttcagtgtacccttctcctgctccagctgggccctgctggaagaaaggccgccaacccctcctgtccctcgcctgttcctccagatcctcccccttgggcacagccagctggaggctgcccctcagggagccccgccctgccccacagagccccggcaggccttgcacccgcattgccaggccccaggcagctccaggggagctgggagtggggtagggaggtgcctcacacatttcaggagcttgatctcatccacagctgtctccgtgtaatgccccgcactcttcaccactttgagggccacaaagcgcttgcgcctgcaataccgagacccttgtaggctgtggccctggcaggacccacggcggggatcagggtggccccaagcaagcccagggacaggatcccagccagtgctgggccccggaggcgaaggaggcactcactggatgtcccagcagagccagacggtggagaagtggccccagcccagtttgcgcaccacgtggtaccgcccattgaacacgtcgccgatcttcacagggtggtagccgcctgcccaggggagatgtagattggggtggagggggttctcactcccctgggcccccgaacacctcggccccattgaccatctggcccatgtgggcccaggactgccctgggtccctgcagtggccgtgaggccgcatgtccccaaggccaagtctcacccttgcagtagtctttggggtcttcctgttcctcgtcgtcggagcccagaaggccctgcagcatctgaggcaccggtgtggccagggctagttcggagcccgaggactcgggcccgcaggaggcctgtgagctgcgggtggggtgagtggcagtgggcatgagagacgccaggggctccgggtgccccagccgagccctacctgctgctactgccgccgctgccgccgctgtccccaccaccgcccgtgctggcgctcatcccggccacgcagcccgc

SEQ ID NO: 139537 - DNA, 1308 bp, Homo sapiens
cctctgcaggtcccgcagccgctcctccagcagccgcttctgctgtttccgtttgcgcctcatcttcttcctcttgtttttggacagcttaccggtctgctgtcagagccagggtcaccccagggttcctgtcgcccgccccagtcagcatgaagtggaggtttccctgcacagccgccagggaagaggcctctccgggccccagggctcccatggacaccagaatgtggcgccagcgccccttggcaccagctactcactactctccctgcctccccgcctgtggccccactccccacagctccattaggagtgggaagacctggccggcccgcctcagggtgctctctgtcccctctcagcccaagctaaggcaggcggaagtggccattcggggaagacagcatcctttcaccaagagcagtttggggcacttgaccccccccgggaattaccgtcagcccagccacccagcctttcgggattaccaccgtgggagtgcgtgaaggtggggggtggagccactgtggctccagagatggcctccagttggctcagatgggagaggaggcatgggagagaggggccccccaacttaccaagacctcctggggggcagtgctgactgggagtgcaggtggggagcggtggggggggacagggaggaacagagactcaggcaggggttcaggcccagaggccccgacccagccccatgtgggcccttggtacctatggagcgggaggggggcggcgcccctgcctgttgccactccgtggcctcggcagccaggcgcctgatgtaagcgtcccccacacacagcaagatgttctcgggcttgatgtccgtgtggatgatcttgcacttggtgtggaggtagtccaggccgtgcagcacctgcagagagtcgcacctgacctcctccaactcccgcccaggccaggctgggcagcccagtgggtggcactcacctgcctcacgatgctcttcacgcagggcacgggcaggccctggtagttggacttgatgatccatttgaggagctggtggcccagcacctccagcaccatgcacacatctgggctgggagtgaagggcggccagtggacaccagctgcggcacaggccccacccaccctcagctaggggagcagcaaggcttgggccgtgtggaggtggggaggcagggcctcccctgggcagtcctggtcaccattatgctggtgtcatcatcgatagtgtccctgtcagtctcaacaggtatgccagttgggatggtgcattttgtggtcatcctagaggtggcg

SEQ ID NO: 139538 - DNA, 1032 bp, Homo sapiens
atagcggcctgagagggcgaaggctggggggatgtcccccagaagctccactatgtgagcgatgtggtctgtgggcagaaagaggaggttgggggcaggcaggccgggaggccgggaggctgagcccagagccctcaccccttaccctcatcacgactgtagtcttctccagaatgcggctcgaacaggtagtcaccagtggccagctcgaaggcctggaagggggaggaggtgaggctgctggctggtgggctgctggccctgggcacagggcagcccgggcgggcgtaccatgcaggctgtgctccagatgtctgccggggggccgtattcggcgccgatcagcacctcgacggcccggtactgccgagtctggatgtcttccgtgaagtgcttgtgctggaagcaaggggagccctggggacgggctggggccaaggctgtcctgcccccacggactcctgccccaccccgatccgcctacccgaggagctcagtggggtttgctgtgagcctcggggtccccaggtcctccaagagggacaggcccagtgatgtgaggctgaggctgatcccttcctagtggcccctgcccttggccatggccccagtgctgttgactgggcaggaccagtgcccacccagccgacggttcacgtgcactgcagactggggtagggctccccaagagcggccctgtgcctccacccttggagcagggccccccactctgctctcccacacttgctcataccacccagcaggcgttgcccaggtctgcgatcttgatcttgatcttatctgcattttggggctccagggggttcaccaggaggttcgaggcaccgaatggtgctggggaaggcagagcagggagactgaagtggtccgactactgccagccctgcctgcccaccacttgccacccaacttactgctaggcgacaggaggcccccggtctctcgctgattggacgagccggagaggatggagcaggaggcaggagagaagagggagccggagaagcctga

SEQ ID NO: 139539 - DNA, 3102 bp, Homo sapiens
ttgctccagagcctggatggagaatggcatggctgcctggctggttgccagcctttattcatttattgacttgttcattccgtcgttcaggggttattcatggagcacctgctgcaccaggtgcccttcgagatccctgagcgtgtagcctcgtggggcttaggctggaagttgcattctagcattctagtgttcaggaaacatttttgctccccaagtcttctgaccccggcagccttcagctgccctgctgaggtggggcggggatgggcagtgccactaagcctgtgttgtgttttgtaggcaacatcgaaaccaaccataacctgccaccgtcgcacaaatctcgaaacaacatccttcggtgagatccgggtgtgcgggctgggggcttggtggggctaaggtggggtgagccagtggagtctggctccagtcagccacctgtcaggcctagcagcctctttctccgtcccctcccagcaccagcctggacctctatgccaacgtcatccactgtaagagccttccaggcgtggtgacccggcacaaggacatagacatcctcattgtccgggagaacacagagggcgagtacagcagcctggagcatgaggtgtgcatggggggcccgagatgagcccccccagcgtcaagattaaggggagagcttaaggaaccagggacaggtgtacccttagagggcaggggctgtgcccgagggagaagccagaaataggcagacagggttgcttcccacggtggcccggtcgcgccagcttgtttggccagtgctgctcttcagtagcacatgggtctcttctccccatgccctcctcagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgtatgtcccctgacctctctgcgagcagtccagaagcagctgcagtggcctgcttgggcctgctctgagggatttgtggtccaaaagcccagctacccaccgaggtgccaccctaggcgagtgccctgttgccctcgaggccttgccagaacccacacttaggggaggtggggtgggattctgtccattttgctggtgagggacaggttagaattcagaccccagcctcctggggccctctgcacgccccgtccctctggctgactgttgcgatggccaagctggtgtcctattcctaaccccccaccaggaaactgggcgatgggcttttcctccagtgctgcagggaggtggcagcccgctaccctcagatcaccttcgagaacatgattgtggataacaccaccatgcaggtattagcctgcccagtgctgtccccctgccctgagtgccctgggcttctctcacccatgcttccgaatctgctcctcagccagccccctccttgtcccgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagtgagtgccggtggcagtgccgcggcttgccgcctttctcctgttcacagacttagtgaggcacactcatcccatccggttagcccgttcaaaatgcatgatttagtagttttttggatatccagggttgtactgccgtcaccaccaggtcattccagaacattttcaccaccccacgaggaaagcctgtccccataagctatctgtccccacaccttcccccaacccctggcacccgctggtgggcttttgtccctgtggagtggcttcttctggacgtgtcacaggagcagagtcactgcccggcatccttctgccctccacccactctccttcgtcttgcctccccaggctacgaggaacaccggcaagagtatcgccaataagaacatcgccaaccccacggccaccctgctggccagctgcatgatgctggaccacctcaagtgagtggctcccagtgccccgcaagcccctggccagccctccgggccccagggactgaaggctggctgtcccatcctctaggctgcactcctatgccacctccatccgtaaggctgtcctggcatccatggacaatgagaatgtgaggttcccctcgcaccctaccctgctgccccgcccagtctccccctgcagcctcctgtagcccgcctcatgcactgaccacagcccccaggggaggatggtactggatctggccccatcttctggcccttagctggtgccacttccctcctgtggcaatcccagtcctgcacgtcacaggagacagcggggggtggcagggcctggtgtgtgccgagcctgcctgtgtcctacagatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctccctagacttggcgtgggcctccctcactccaggcaccgatgttcagtccacactttattaagaaaggaatacacacactttctccgagagccctcacgggggtctcaggcagaacacgctctgagagccgggcctggctccagcgtctctctgccctgtggttgtggagaactggcgcccagcagggtggtgggagctgtcccgcttttcccttaaggcacggagagctggaggtggagccacagccgggcctaggggttgagccaggggtgctggaggcagtcagcggcactggcccgcttttcggggatgtactccatcatgggcagcagaaaggcgctgaactgtgtggcctgctctaggggccactcgtacttttccatgagtacctcgtacaggccccagtgcttgagattgtggatgtgccgcagctct

SEQ ID NO: 139540 - DNA, 2618 bp, Homo sapiens
atcagaagcaaaaaagaggagggagggcagggacacgccttttaagaaattttctgaagagcggaaggaggcaggaggctggagcgccttctactttccaggtgctccagcgggccggccctggggactgaggctttggagctaattatctattgtgcccctggcagtgggccatgctgcacagacaggggacctgcctgggcacagtggggacggtccgtttttccttccaacttggctttctgggttagacatcaaaccaaccgctggcatttggtctctgccaggttctaggcgcccacgaggtcccctcgaggaacatcttttcagtaagtacctgcccgtgcccacgcatgtgtctttctccatgtggccgcaattgtgcgcgtgtgtgcacggcctgtgtcctgtcctctgagacgtggtctccaggggctacccacccctcttctgggagttgtactagccagcatccccctgggaaaaggtcccactttcctggtcacggccttgctcttggaaccttggctgattgtgtcttcttcctttctcatcctttctaggaacaaacaattgtgagtattcttctctgcctgttaggtttggggggctcttagttgctttggggttaactaaattccaggtgggggtgggctgctgctgacccaggagccctggatgagcagccctgtctgggacggggctgccccaagttggcaccttgtgacggggcagcctgtggggtcagcgccagtgggaagaagggaattggcttgagcccatgggggccgagctgggggcatgtgggatccccgaaggcccaccttcaccctctgcctcccacagcctccgtccgctaagtatggcgggcggcacacggtgaccatgatcccaggggatggcatcgggccagagctcatgctgcatgtcaagtccgtcttcaggtatggagctcctgggtccccgccttgtcctcagccagggggccctgaggactttgtgccaagaggggcattgcgcccagaagcactcggtgaggccatggcaagacgacctgtaagcccaggccttgcgtcccatggcctgtgatcccgccagactggcctgggctcggggaaggtggcaccagtcctgccacagtgtgcattgtggagttcaagcgtgtccccatcagtcagtgaaggtgggcccagtcccttctcagtcagagccaggtcagggcaggtagcaacaggagagaggtagcctgggcaggcttcctggaggaggtgcgggggggtctgggccagcctccctgaccctgccgtgcctcaggcacgcatgtgtaccagtggactttgaagaggtgcacgtgagttccaatgctgatgaagaggacattcgcaatgccatcatggccatccgccggaaccgcgtggccctgaagggtgagctccagggccaggggccaggatggggccctaggtgtgatttctttcttgctttcttccttcgtttcttgcttacttgctcgcttgcttgctttcttgcttgctttcctgctttcttgcttgcttgcttttttgctttcttgctttctttcttgcgttctttctgagatggggtctcgctctgtcgcccaggctagagtgcagcggtgtgatctcggctcagtgcaacctctgccttccagtttcaagcgattctcctgcctcagcctcccgagtagctgagattacaggcgcccgccaccacgcccagctgatttttgtattttcagtagagagtgggtttcaccatgttggccaggctggtcttgaactcctgacctcgtgatctgcccgcctcagcctctcaaagtgttgggattacaggcgtgagccgtcgtgcccagcccctgtgatttcttttacctccctctgagctgactcttgtggggccccacggctctgatttcagggcttgtctggctagagaggaccctcgtgcttggagactgggtggacgcctcctcgggcctgtttgcgctgcgatgctgggattcgagtgagagcagctgtgtgtgagcctgtccagtgacgggctccctgatgggttccctcccacccctccttccctcctgagacagtcctctctgctggggtcagctttgaccctcagcatctttcttcacaaaccaggtatcacagagatgcagttccgaccctctgcctggctcctcggctgcagccagcctggaggtggatggcacagcccaggcagggattcttggggcttcacttgaggtccttaaactacttccattgctcattttgcacactcagcccattacttgcactgtgtgaggagcgtgtgagcaaagatgaacccagggggagccccaggccctggcagtcaagtagaggggcctttgtgccagccacaggggacccccgcgctgtgagtggagcagtctgggtggggtaccgctcaccagcaggcggcctctgcttggcgccctctgactgctgtctccagcggccactggcctctgcttcccttcctccaggtgtcctgggtcgtagggtagggtccggccaatccgtggccttctccaggcagcccccgcctgcctctgagtgtggtgccttgatgcgggg

SEQ ID NO: 139541 - DNA, 1085 bp, Homo sapiens
ctgatggctccagcaactgggctcctgtaggctcttggtgaagacatgtgtgcctcctccctgacctcccctgtgtgtgtgcctgtgtgtgcgttggggtgggagtaggggacagtgaacggtgggtagctgggcagtgccttgccctgagactgaccgtcctgggtgtgagaacccttacagaggaaccccaggtcttgaatcccactgatttggacgccataggaaaacatgcagccaccattgacacatggtccaacagaaatatgccaaagacagaagcctcagcaggcataagatgtggggtgtggatgttctttctttccatggaaccatgaaagggtgatgggagagcgggaggcgtgtacatattgcatcctgcctcacacttggctcctttgattggtggcttcacagggaagtcagggcacaaggcagagcctttgcgacctcctgaaggaaggtgcctgcatctgtacagtaaggtcagggaagtccatctggagcgctctctgggtcttttgccaaagcccaaaggaacacctggcacagggaccgggtggcagagaggttcagctcagccctggtggtgatgttgccatctgtgagggaggtccatgctctcaggagattggcttgctgccacagctgaagcccaggaggaactactgctgggagctgcaggggtccacccgtgacctcccagggacaccagccttgaactctgacctgaggggccagtggggtgaaggggcaggcgtgctgtgtggcactagctactgtgagcagctcacacacctcctgtcccctaatctttccaacagtcacggaaagtaggtacctccgttctgtgaatttcagatgaggccatgaagccatctcaagaagagtggatggtggatttggaccgaggcctccctagtctccagatcttttttcattttctgatgtgcttgttcactcaggaaatgttccttatgtgccagctctgggccaggtactgtgctgggtcctagggtgacagtattggaccacactgacttggcccctcctctcgggctcaggggttgaggagggagcaatgc

SEQ ID NO: 139542 - DNA, 1013 bp, Homo sapiens
tcgggtgcggctaccccaccgctcccctgcgaccgctgccgcggtcccgtggctctttccctgctcacctcccagggacggcagagaagggctggcccgagcaccgccttcgcggcgctgccggcgacggtcgctaccttcagcgccatgacggaaagtgagagcctccgcacgtcccgacacgcagataccgctctcgcgagagttcgacggggtgcgaagtttcggggacaggcgcggacccggtactgcgcacgcgcgcggtcgcaccgattcacgcccccttccggcgcctagagcaccgctgccgccatgttgagggggggaccgcgaccagctgggcccctggctcagggaggggccacgtcagtgctgccagagacgtcacaatgccggcccagccgttcggtgcgcgattggctgccgctgccacttacgcgtcgctcttcctcgtttgcccctcgtgttcatgggagctcgttttcttttcctctaggcagagaagaggcgatggcggcgatggcatctctcggcgccctggcgctgctcctgctgtccagcctctcccgctgctcaggtagcggcccagccggggcttctttcttgcgagcctctgacccacggcaggtggtgttgggggcaggagggatgcgggggtccggcctttcagggtccgtcgctgcgggccgggccttcccccgagaggcaggcggccttgggacggggggaccaaagcacctcgcgcacgtttaccggcagccaggcttttccttgtctgcccatacgaagaggagtccccgagcctccatggtgcgcccggcccccaagctgcagcacggaacgtgacacatgtcccggctcccgctccctgcggggtcggaccggagcgaagctctgtagcgctgagcgatcgcggccaaaaacggggctggaggagccacataagctaggaagggacctcagtgaggagagggagcaagagcggggcgagttagatggggagccaaaggtgc

SEQ ID NO: 139543 - DNA, 2780 bp, Homo sapiens
ccagtgcattgcctgcctgcagcccccacccccgatgtctctgctgaggatgccttcagtaactcgtccaggccgtttgtggctctgaattgaggctggcgtggcccccgggcctccgtgtcataggtccaagtgttggcatgtattgtccagtgaatccagcccccacctgtccccagttcgctcttcctgcacacctccagaaagccggccttgcccctccccagccttccttcacagccatcccgcctacgttgccattgcatttgtgaccgagcacttggatctgtctcgcatatcccacctggaaggggcaggaagagcgcatgggtccccagctgatccgtgctatgaggcagggccgggccatcctgccctcagaccgggatactcgagctggccttacccaggcatctctccctcttccccgcagccgaggcctgcctggagccccagatcaccccttcctactacaccacttctgacgctgtcatttccactgagaccgtcttcattgtggagatctccctgacatgcaagaacagggtccaggtgagacagtggggtttcagacaggagggcgggtggggggtgctcctcactgctagttgatgggggacctgtgtcgatagagggagaatcaagattccaactcttggggtgccggagagatcagggcacggtgatgccagatcctagccagtgttgacaggtcaccttcctcacctgctttgtgtgctgtgcctacacgaggtaaccctgggctcaccacccgctgtttcctgaatgagtatctggaccgggagaaagggccaggagtcagcccaccccggttgccattggccagtttgtctgtgtgggtgttttgtttttgtttttgttttttgtttgtttttttgagatagggtctcactctgttgcctcagctggagtgcattggcacgatcttggctcactgcagcctccacctcccgggttcaagcgattctcctctcagtctcctaagtagctgggatgacaggtgctcgccaccatgcccagctaagttcccataagtccaaagaaggaaatggggccttttttgggtatggccctcttagggtaaagcaccccttgggcagcccactgggcacccctgaccccagcacctcccttgtagactcaggaaatcactcagcccttttgatcatcccgcccctgctcacagtcaacagggttcctatgcgtccagttaggcccggccatggggatctggccttgtgcccccgtagggaagaccaatgcagagggccagtcacgggattggtgagtgttacttggtacctcctgccagggacactgcagcccccaactgggcctagcctgcccacctgcaggccgtgtgagcagcgcacagggctcctctgcccacacccagagggggcagaaggtgaccctgcctttgttccctcacccagaacatggctctctatgctgacgtcggtggaaaacaattccctgtcactcgaggccaggatgtggggcgttatcaggtgaggggccaatggttcccttgctagggggctccctgctcccgggtgtgacctgaagccccaggggtggccggtcaaccagggccaggggccgtgggctctggctgccggagtgctgcagtgtcggcactggtggtcagggtggcccctccgtgtccactctgcccacactctgctcaacacccaacccaggtgtcctggagcctggaccacaagagcgcccacgcaggcacctatgaggttagattcttcgacgaggagtcctacagcctcctcaggaaggtgaggactcctgtagcccactgtgctcccctgtccctggggagcaggatgggctgggttgggaggtgctggcagcaagtcctgagctgggtggcctttctgtgatcctgtcccttcctcagtgtctcttgcccatttctctcctttccttttctggggcttgggccggtgttcctacctgtctttcccctcccctccccacccccacacgccaggcacccctgaccccagcacctcccttgcacctcccttgcaggctcagaggaataacgaggacatttccatcatcccgcctctgtttacagtcagcgtggaccatcgggtgagtggcctggtccctcctcctttttggggttgttgggctgagtgaaggttatcctctccacagccccagctctgctgctgggccgtgattggccagcatgtcttggttcccctggcggaaggtgaccagggctggctggtctgctcacctgtactcccctgagctggcttgtgatctcctttttttcagggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctggggctgctggcttgcgttattgtgccttcccccgactgggagagctgggggcccagcgtcctcttgtctgcctggccagcagaggcaccaggcaggaaaggggtgggctttggtctagaactcccgtccctcctcccaatgaagccccccgtctggtccccacaaaaccctgtatccaccttcccagtgactctctcctggttctggtgagggcagtgggcttggccacctcctccccaggtggccccacaggctccatggggaaacagccagcctg

SEQ ID NO: 139544 - DNA, 4677 bp, Homo sapiens
cgaacccatcttgggcagatgtcttgtgtatccccaggagggggatggcccctcgctcccctccctactagtagcatcccactaaagccacccttccagatggacaatgtcctacttcccaccaatgcccggggctgaccaaaagcacaggcttccgtgcagaagagcctaggagtgcagggcaggggcggggagaggtgactactccacagcctctgcctctgcttcctggggctcagagctggaaggggagccagagagccttcagcttgctttgggggcccctgaggtgagcctgcccccttctaccgaaagggcatgttaggcaccaagtccccaagatgcgtgtgtcctgcaggtaaatcccaacagcattgcagccaaagacggccggatccgtgagggagaccgcatcatccaggtgagcacttgcaggctgcaggcctggcccaaggccccgctgtgcccgtcggcccagccacctctctttagccagtccctagctctctcccactaagagctaaccctgaggcccagcagcctgccgtgtcctaaacccgggctgagtctcatctctctcctgcccactcaccccagtggctcccgtgtgcctatgggatctgctggcatccagggcccctgctgctctgaaacctcctggcccctctccctctgccccactccatgctctcctgagcacacatttgctcttgcaagagtcaggccgccctctccctggtaccttccacttagttacatcctcccagagctcaagccccagcctagcccagccgagcccagagtgcttgggctccctgcacccgcccagggtccgccccagggccagccctagcatgcttgttgattgtatcctgcctgcctcagattaacggtgtagacgtccagaaccgggaagaggcggtggccatcctgagccaggaagagaacaccaacatctccctgctggtggcccgacctgagagtcaggtgtgtatgcctggcagggcgacccggggccacgacatcaggctttctgtcttggaagctgctggccgtgactagggcacagatgtgccaacgacctggagttgatggagggcgggtgggcaggggtctctcagggcccgtttcccctcctggcctctgaaggctgagggggctgggacgctgcccccaggttgctgagcttcaccgaaacaagccaagtgcggggtccagagcagacaagaagggtatatggggaggtccttgaagctgtggggacaccagggcctgtctccacagctggcgaaaaggtggaaggacagcgaccgggatgacttcctggatgactttggctctgagaatgagggggagctgcgtgctcgtaaactgaaatcaccccctgcccagcaggtgaggaaggaaaagggcgctggtggggagggcgaggaggagagaactgggtggaaggcgctgaggctgtgcagggtctcccaatgcttggcagggaaatgaaccaggcctgaagccccttccgatcctcctgtgacatcccgtgacatccctgtccgtgggacctaactgagcggtacttacctttctgctctagcccggaaacgaagaggagaagggggctcccgatgccggcccaggcctgagcaacagccaggagctggacagcggggtgggccggactgacgagagcacccggaacgaagagagctctgagcacgacctgctgggggacgaacccccgagctccaccaacaccccgggaagcctgcgcaagtttggcctgcaaggggacgccctgcagagccgggacttccatttcagcatggactctctgctggccgagggggcggggctgggagggggcgacgtcccgggcctcacggatgaggagtatgagcgctaccgtgagctcctggagatcaagtgccacctggagaacggcaaccagctgggcctcctctttccccgggcctccggaggcaacagcgccctggacgtcaaccgcaacgagagcctgggccacgagatggccatgctggaggaggagctaaggcacctggaattcaagtgccgcaacatactgcgggcgcagaagatgcagcagctgcgtgagcgctgcatgaaggcctggctgctggaggaggagagcctctacgacctggcggccagcgagcccaagaagcacgagctgtccgacatctccgagctgcccgagaagtcggacaaggacagcaccagcgcctacaacactggggagagctgccgcagcaccccgctgcttgtggagcccctgcccgagagccccctgcggcgggccatggccggcaactccaacttgaaccggacccctcccggccccgctgttgccacccccgccaaggcagctcctccaccggggagccccgccaagttccggtccctctcccgggatcctgaggccggccggaggcagcacgcggaggagcgcggccgccgcaaccccaagacggggttgaccctggagcgtgtgggccctgaaagcagcccttacctctcgcggcgccaccgcggccagggccaggagggcgagcactaccacagctgcgtgcagctggccccgacgcgaggcctggaggagctgggccacggccccctgagcttggccggtggccctcgggtgggcggggtggcggccgcggccactgaagcaccgcgcatggagtggaaagtgaaggtgcgcagcgacggaacccgctacgtggccaagcggcccgtgcgagatcggctgctgaaagcccgtgccctgaagatccgggaggagcgcagcggtatgacgaccgacgacgacgcggtgagcgagatgaagatgggccgctactggagcaaggaggagcggaagcagcacctgatccgggcccgtgagcagcggaagcggcgcgagttcatgatgcagagccggctggagtgcctgcgggagcagcagaatggcgacagcaagcccgagctcaacatcattgccctgagccaccgcaaaaccatgaagaagcggaacaagaagatcctggacaactggatcaccatccaggagatgctggcccacggcgcgcgctccgccgatggcaagcgggtctacaaccctcttctctcagtcaccaccgtgtgagctgcccgggcgggtacacggcccaggcccagggaaccccctggggccccggccctcactctcctatagagattgtgtgtgtgtgtgtgtgcgcgcgcgcgtgctcgctgtgcgcacgcacacatctcctcgtctgggtgtgcgcacagggctttgttagcagagagaagcccctgaggagaagggacgcttttcttccttctgcccaagtaaagtgaccatgccagtggccagcactgggggcacacctgtgatgggcaccccttcagctgtgcgtgtgcattccccatcccccatgctcttgcgtgtgcttgcacgtgcacgcacacacacacccagtgctctctccacccgacccgtgtacttgcagacagggaagctgagctgaaaggagcacaagagagtgtccggcttcgctgctgagcgcggcctctccccgccgctgcgcactgcagttatttgtagacaaaggcacccctgatttttgtggtttttctccctttctgtgcttgccaatagttgttttgttttgtggacctgccctgggggctggcagctccttcaggcagcctggcagaagtggaactcccctctccactgatggctgggaagggagttggggaggaagagtgggagggagggctggggatggatgggagggaaggggagggaaaggtgggaggaatgggaagcagctgttctggtggcttccactctgaggtgtgggaacggggagcctctggggggcacctgtttccccagtgactcagagagagcaagactgcaggaacggaggggtcctgcagggtgtccaccaagaagtcacagagcccgttctgcgccccacaccatctggagcaggggcttctcttctgagtgaactgaggaaggtgcttagatggtgagggctctagaaaccaagccccatgagcagcagtggaagacctcgggccatgcggcctggggaggacttggtggcgatccgcaacctggaccccagtgagaggcggtgggctgactgggaaggagaggcccccaacctcctcaggatttgcacgtgtgaactaggctgcctgtggggtgccccttaggcttggagagccccagattggaggcagacagactgcaccaccccttccccccctgcatctcaagaataaagcaagctgcctttgtacttggttgaatcgtggcctccctgtgttcattcttattgggctggggaaagagttgtcagtttggggtgggagaaggaagaggggggcagggttagggtcaactgaaagccacgctgcagccctcggtttgtcttggatgtcaggagcagtgactgtgacctcccatggacaattgtgtggcactccaggagatataccagagtcgcctgagtcatttcagaggtgtcacagtcacagggtggtgaccagatgcagaaggctggcagaagcctgacttcagactagcctccaggcaagggccacggtcatctccatgggccaaaccgtaggtggggcccgctgctggcacatgccacagag

SEQ ID NO: 139545 - DNA, 1116 bp, Homo sapiens
aacaaaacaactattggcaagcacagaaagggagaaaaaccacaaaaatcaggggtgcctttgtctacaaataactgcagtgcgcagcggcggggagaggccgcgctcagcagcgaagccggacactctcttgtgctcctttcagctcagcttccctgtctgcaagtacacgggtcgggtggagagagcactgggtgtgtgtgtgcgtgcacgtgcaagcacacgcaagagcatgggggatggggaatgcacacgcacagctgaaggggtgcccatcacaggtgtgcccccagtgctggccactggcatggtcactttacttgggcagaaggaagaaaagcgtcccttctcctcaggggcttctctctgctaacaaagccctgtgcgcacacccagacgaggagatgtgtgcgtgcgcacagcgagcacgcgcgcgcgcacacacacacacacacaatctctataggagagtgagggccggggccccagggggttccctgggcctgggccgtgtacccgcccgggcagctcacacggtggtgactgagagaagagggttgtagacccgcttgccatcggcggagcgcgcgccgtgggccagcatctcctggatggtgatccagttgtccaggatcttcttgttccgcttcttcatggttttgcggtggctcagggcaatgatgttgagctcgggcttgctgtcgccattctgctgctcccgcaggcactccagccggctctgcatcatgaactcgcgccgcttccgctgctcacgggcccggatcaggtgctgcttccgctcctccttgctccagtagcggcccatcttcatctcgctcaccgcgtcgtcgtcggtcgtcataccgctgcgctcctcccggatcttcagggcacgggctttcagcagccgatctcgcacgggccgcttggccacgtagcgggttccgtcgctgcgcaccttcactttccactccatgcgcggtgcttcagtggccgcggccgccaccccgcccacccgagggccaccggccaagctcagggggccgtggcccagctcctccaggcctcgcgtcggggccagctgcacgcagctgtggtagtgctcgccctcctggc

SEQ ID NO: 139546 - DNA, 2774 bp, Homo sapiens
tggtctcgatctcctgacctcgtgatctgcccgcctaggcctcccaaagtgctgggattacaggcgtgagccaccgcacccggcctagtggtggctttataaggaccactttcttggcacctcttttaggctactttgcagttccagggggcttcttgtacatcaaggccttttctcttgggcaagtcagttgtcactgtgaggacacaacactgtatctttaggcatcttcctacttgtcccccaacctgaccctggccctccctagtgagtagacatttgttgagagactcggctcatctgaagagtcaaggtcatcctcttgcttgatgctgaatgagcacaacacagatgctcactgagtgttggctgttatggtccagtcattgccaaggaactcaatgggatcttcatgctagctctggcctcagtgccgccctagaaagaagtgggtccggatggggagaggccaggagagctcaagcagtgtctggaggacgttgtagggcggtatcacagcctccagacccagtgcacagaggctgggtcccccagtccttggtgtgacttggtgatccccagctggccttcagtgggatgaaggctgagcagtggggcttgcctgggaacaggggcaccaaaggtagccagggctgcagacagcagattccttgcttgagtggcttggggtgctggttgtcagcccaggtcctgccagctagggcctctgccttgacctcagaggggaggagcaagcctttgagggttcttacggaggcgtgtctctgccgcaggtgaacgggaaggagctctccaagctgtctcaggagcaaactctgcaggccctgcgctcctccaaggagcccctggtgatccaggtgctgagacgcagcccccgcctccggggggacagctcctgtcacgacctgcagctggtggacagtggcactcagaccgacatcaccttcgagcatatcatggcgctgggcaagctgcgtccgcccaccccgcccatggtcatcctggagccgtacgtcctctctgagctgtgagtcgccctcaggagggccccgggccctgcctccagagaggacaggccacctggagcggccatccgcacgccaccctctcgggcaggaagcaggcccctcggcctccagaactgaccgtggtacccaagggctccaaaacctccaggcctctagccttgggccgggctccagcaggcgccccgttgtatctacccccagggccgagggaggaccctcctgtccgggacgtcgctgccggaagtgccagggttgagggcctcagctcctcctcctccatcctctctcctctgccgcctcacaagcatcactccttgaatcttcttgcatcccttgtctgtctcattcctctacctgctctgaatttcctccatctcttcagcttctttctttggcccgaccggaagaagggcctttcatccaggcctggtggctcatgaccgcgtgagcgctgcctcattctgctaatcttagcccgggctgcggggaggtaggccacagggccatgagcagccaaccttagttttggggccaggagggcagcccctggaggtagggtgggcccccctctgctctgcagaagtcctccagggcctggataactcctgggggcgttgcatgagtggggccagtgctgggcgggcgggtgggcacccggagattggagaagttggtccctgccagctggcgtggttggaggagttctggtctgggggacgggaacgctagaggcatgcgcaggtcctctgcgtggacgctgcacactcaggtgcgagaagtgcccccggtctttgcatggctgcatgttgcccaggaaggggctctgcaggaggcaactgggccacccacccttgagagcacaagcagagcaggcctccgtgccaggcacgctgggatcggcctgcctgggagctggggctgaggtgtgagaggatggccagctggtctgacccccaccttctcctgggcagccccccaatcagccatgagtattatgacccggcggagtttatggagggcggcccgcaggaggcagaccgcttggatgagctggagtatgaggtgagccgggtggccaggccagggcccgcagccagctgcgggagccgccccgacgcctgtgtgccttcctgcccaggcccaaccccgtggccctcctggcacgcatctggctgagtcagggagggtgcgggtgaggttacgtgttccgtccatgtcggtgagtccacgtcccatgcacgtctgtcttctgtgtcctgtgcctgtgtgtgcctcgtgcatttcctgggagggagaccactgagtacgtgcgccacgtgggatggtaagagagaccctcaaagcggggcctggaaactgagctcagggggctccagaggaagctgaggggctgcgggctgaggggttgcgggctgaggggctgggctgtgctgcctgctccctcactcacgcatttctggggctttctacctctgcttcctcccggacccctcgtggcaggaggtggagctgtataaaagcagccaccgggacaagctgggcctgatggtttgctaccgcacggacgacgaggaggacctgggcatttatgtcggagaggtatgcagacgggtatgccccagccccgaggcccatccacatggcctgcctgtggctcagaggctgcccttaaggtcccagctaccagaaacagggcatcacagctagggtgctgcgtggtgaggc

SEQ ID NO: 139547 - DNA, 1022 bp, Homo sapiens
cgggtcataatactcatggctgattggggggctgcccaggagaaggtgggggtcagaccagctggccatcctctcacacctcagccccagctcccaggcaggccgatcccagcgtgcctggcacggaggcctgctctgcttgtgctctcaagggtgggtggcccagttgcctcctgcagagccccttcctgggcaacatgcagccatgcaaagaccgggggcacttctcgcacctgagtgtgcagcgtccacgcagaggacctgcgcatgcctctagcgttcccgtcccccagaccagaactcctccaaccacgccagctggcagggaccaacttctccaatctccgggtgcccacccgcccgcccagcactggccccactcatgcaacgcccccaggagttatccaggccctggaggacttctgcagagcagaggggggcccaccctacctccaggggctgccctcctggccccaaaactaaggttggctgctcatggccctgtggcctacctccccgcagcccgggctaagattagcagaatgaggcagcgctcacgcggtcatgagccaccaggcctggatgaaaggcccttcttccggtcgggccaaagaaagaagctgaagagatggaggaaattcagagcaggtagaggaatgagacagacaagggatgcaagaagattcaaggagtgatgcttgtgaggcggcagaggagagaggatggaggaggaggagctgaggccctcaaccctggcacttccggcagcgacgtcccggacaggagggtcctccctcggccctgggggtagatacaacggggcgcctgctggagcccggcccaaggctagaggcctggaggttttggagcccttgggtaccacggtcagttctggaggccgaggggcctgcttcctgcccgagagggtggcgtgcggatggccgctccaggtggcctgtcctctctggaggcagggcccggggccctcctgagggcgactcacagctcagagaggacgtacg

SEQ ID NO: 139548 - DNA, 1067 bp, Homo sapiens
acagcggtggttctactgtatcgcgggcactaagacaagattttgccgtcagaattgacatctctgtgagaaacccggggtgggaggtgccgccgtgagaatgcaggacagagagttcttctaaacttgctaatattcgcacaactcggaaaagcagagggctccgtgcaggcgcagccacctgcgcccatgcccagggcccttctgccctctcatctggcacaagctcccagcctgctccatccctaggcggactctgggtctcctcgccctgccctctctgtgctgactgggggctttgcttccaactgcaaaccagcctccctgggtcttttcttggccctgttccctttgcctgatggaggccaggtgtcccctgctccagaagccttccccgcctcccaccgaggcgtgcatggccagccgtgtgctcccttagctgtgggtaaggtctgtccccacgctcacctgcggggcatagccatttgggcataatgctagtgtgtagcctccccaggcccagaacagcccttccataagccgctgagcccatgaggagaccctgcacgcctgcctcgagctgcctcctcctagaagtgcttcctgctgacccttgctggccccatggcacgtgccctgaattctggtggagtctgttcagtccttcttggtccttagtcattcgtcccttctctacttgcctcccttccccaaggaggacttgaaggtcgcagcatactgtcccagggtgctgcggaagcagccttcgaccttgtgggcactgcttgccccaccacctgcgctgtgcgtaatgggcttccttctgctacccttcattgtccttccttcacccctacagcatcccgcagagctgcttaggtcctacttccgccttgggccctggcccgcgatggcctcctcctccctgacccctccttctggccaccgggcagcctgtcctggctcatgaccttgactcagtgccacaaccttgctgagcttgctgacatggtttcctcatctgcaataatggcatctccctcaaggttgttgggggttaggatttt

SEQ ID NO: 139549 - DNA, 1130 bp, Homo sapiens
tattgagaatttcgtctctatcccacaccataaagatattgttctcttgttttgctttgtccctgtaggtctttgatccaattggaattgcttggccagggcttggactaggtcttctgtcttggtggggcgagctcccagggtgtggaaacgtttgcaggtggggcaggagggagagtctggtgggaagcaagcctggggttggccatgttgagtgtttgtgccttttagagactggagtggtcgagtaggcaatccgagggttggggcattacaggggtggctttaccagtgtgctacctcaggatggttgggggtggggcggggaggcaaggctctgagcaggactggaagagctgctgtcatcagaagggccacagtgtggctccttaccatgtgcctggccctatacctctttgctcatggccccatattttcccaccttgttggtagcccttagcccttccccagaggggagctcatttcttccttgggggtccagcatgaccgatgaggaggagagagagagagagcgagaaggcttcaggagcccgtggcttccacccaaatacctgcctggctgtcacaggcgatcactctggttgctgctgatccgaggtgctgaggctgtgcccacgcccatccccctcttgacatcccagcctccgccagcccgcccagcaagcgctcctcagtttccatagcaacactgctgctcggtaatgattccgggtagaaaggcattcgtgcgttctctgtcatctctgtcacctgagcatcccactgcctgcttgctgtcctgccccgggagttcaggaagaaaccctgaggacagctccgagcccttctgcttgtgtgttggcttctcctcaagggcagtggtaaggtggtaaatgttcccagacaaaaagccctgatttggagcatttgccgatttccctggtgtaaatgctgccactatagccgatttcaagccaccactgcgatgtcactgaacttggagttgggggaatgcacacatagtatttccatctcccataccagatgtgaataaccccaaaagcacagatgacagaaaagtgtagtaagataattagacagtgatgtgttccgaggatttattgcctttg

SEQ ID NO: 139550 - DNA, 1144 bp, Homo sapiens
attgacaaattcttctccagaaatttgaccactttacactctggggtaagattcagactaagtgtgtctagaaagggtgatggggtcggctgggaggaggaactgggcttgcaggggacctggggcagtgagtgctctcagtgtgcaaaggggaactgggctgtcccaagcaggatgtgagggccacttgggccacattcaggcagaggggccctgctaaggcttgagtcccctgttcagagcagggaccatggtggaaattaaggacgttcatgtcaactgtggttgagattggagctgcagtcctagagtcagccctcttgggcccatcttggcagcaaatcaggaaggaagtagatctgtgtgctgaagagtcgccatggggcacgtcaagcccctggctgagccgtggtgtgctcacaggctgctgcactccccggggcagcggagtgccagggacttgtattttcatctttgtgctcctccgcctcctcagtgtggcgctctgagcacttcgattatttgaaaggaaatgcgaaaatttgtacaaaatctattgtgctagcacgtgatggaggaggggtctttgtgaacaggctttgagggtttgcttggctcacagctcactacccagtcaacagggttgactgccacggggtgacctcgctaaggtgaagcatgatgcccagcacgtggtcaggatggcacgggagcactggagaagatgagagtcgctgggaacctgggcgaggggggacaaggggcatttgagtgggcttcaggtacgtgaagtgttgcaagataaagtgggtttcttctggattgttccaaaggagggaggttgctctcaatgaaggaaacattcaatagtgagagttttccgataatgagctcagtcaacaatccccactctccccatactagagaagcaaagtggatttcttctggattgttccaaaggagagaagtttgcacttgatgaaggagacttttttttggggggggggtggggggtggatggagtctgactctgttgcccaggctggagtgcagtggtgcaatctcagctcactgcagcctccacctcccaggttcaagtgattctcctgcctcagcctctcaagtagctgagattacaggcgtg

SEQ ID NO: 139551 - DNA, 1550 bp, Homo sapiens
taatatgtgcgtggtccagaaaccggaggagcagtacaaagtgatgctgcaggtagggccgccggcgctgcggcgggggcgcggccctccgcggggaggagcgggccagtggggaggcccggagcggcgggcgtgggagagcgggagggctcgaggaggacaaggtagggagccgtccgcaccctcccatcctggggctgttgggtgttggcgctccgtgggaaccagccacgggtggggtgggaagttggggttggcccgggtggggcgcgcttccgtcccgggaggcgcggtgcggcgggcgcgggatggaggttgcatagcaacgagcgcagttccccgcacacgctctccccgcaggacccagggcgggggagggagccaggctcccgccgtgcggggggcgccgaatctagatcccggcgggcctggagcgtgggagtgcgtgggcgtccccgggcgcggtccaagtccgtccgggggctgggtgcccaccccgacacccactcccgcctggccctgcccgaacgatgggctcccgggccttaggcgtctcgggtgagtgggcgccgccgggatcagcgggttgggctctctgcgggtggcagtgcctggccgggctttgcggggcgtggaccagcagggccccgcggggagggaaggagacgcggggcccggagctcggacctggagcccagccccgcggcccggaacggggcttcttgcctgtgcgtggcgtgactacgtgagtgcgttcctgtgccccgtctctgtgtgcgcggaggctcccccggccccgcatttgtgtactttctgtgtgcaccctgcagactgtctagagaaatgtcccggatgctgtgggctgagacctcctagggctaagtggagggaggtcaaggtcaaggcacccaggagcagacagggctcagacaggtatgcgtttagtggcctggattcaactcccgggtttattggtctggactgggaaggaatcaagtgctttgcaggaggggtgttggcttgggagaacgtgggggaacccgtgcagggatcggcgagaactccggggcgggggcgggggcgggggaaggaggggctgggcacgggggagaattcccaggaatccggggactgacttcacgctgtgagccgagctcctctggccacctggtgcgggagccgaggggcagggcggggacgcaaatcttgccccaccctggcggagctcctggtcctctctccccggcccttctccgggggtgcgcggggccctcggcttctcccgttcgctgtcctccgccttcttccctctcagttcccggctgccactcctcgtctcttgttcccgctgtttggaaaccttgtgtggccattgccagccccctagcgggataggaatgcgaccgagagggcgtcctgtggaatccgtgttggattccagggctgggatggttggttgacggggactctggatcccatcctcctgcttccttttcgggagtcattccatcaaacggcaagcgatttctccaagcgattcctccggggcc

SEQ ID NO: 139552 - DNA, 1516 bp, Homo sapiens
ggtcaggagatcgagactatcctggctaacacggtgaaaccccatctctactaaaaatacaaaaattagccaggcgtgatggcgggtgcctgtggtcccagctactcgggaggctgaggcaggaggcagagcttgcagtgagctgagatcgcgccactgcactccagcctgggtgacagagcaagactctgttaaaaaaaaaaaaagacatttatggacattctaatattaaatcaccttgctttactgacattcgctgaacttggtcattattggctattttcctttatacacatttggatttggtttagaaaaatttttgtgagagtggggacgtccagcttcggagcgggaatcttcgctgcgccagcgactaaaaggagaattaaatatgggtgatgttgagaaaggcaagaagatttttattatgaagtgttcccagtgccacaccgttgaaaagggaggcaagcacaagactgggccaaatctccaaggcctcttcgggcggaagacaggtcaggccgctggatactcttacacggttgccagtaagaacaaaggcatcacctggggagaggatacactgatggagtatttggagaatcccaagaagcacatacctgaaacaaaaatgatctttgtcggcattaagaagaaggaagaaagggcagactcgatagcttttctcaaaaaagctactaatgagtaataattggccactgccttgtttattacaaaacagaaatgtctcatgacttttgtatgcataccatcctttaatagatctcatacaccagaattcagatcatgaatgactgacagaatattttgttgagcagtcctgatttaaaactaagactggtttgtggttaaatgaatacgttcagttcttgaattttaatagtaactccaattcagtaaatgctatcactgtttaccccttctaaagatatgattagacttcgttagtaatgttcaacttttcacaaagatggtgagtgccgtcttaaaacttactggagattggttttatatttagatttatatgactggttatgtgaatatatgtaaatactggggaaattccttcactgtcttagaaccaagcaagattcacctgtgttttgtgttcatttgcctcttaaaggcaacggttgaaggtaaataagggagcaatgtctatagttttggccttaactatgccaatctaattagaattccctgcattaaaaaaaaaaaagaaaaatttttgtttaggacttttgtctctgtattccagaccaaaatggacctacaatcttcctatcttgttctgtttttgcctagttaatattaaggttttgttgggtaatggtccttccttttcaattctctggcagagtctgtagagttgctagaacttgtctgtaaaaccatgcgggccggctgttttatttgtgggaagatttttaaaccgctgcttcaatctgttttatacttttagggttactagggctcgcttgcttgcttttttttt

SEQ ID NO: 139553 - DNA, 2020 bp, Homo sapiens
ggactcccttggtgccagaatgagccatttgttccttggccctcggtcctcgtggctctccaaaagaggctgcagcattgatgtgttaatactttcctttccagccccagagaagaaccctgtggatgtgaagggggaaggaaatgagaccaccaatatggtcatcacgtggaaggtgagagtccctgggctgagctgcctgggggacatgaggccatgacctgggtgtctgttgctcccccttggctatgcaaaggaaggggctgatgtctggggatgctggtttgtgctggggggcgggccaaagaatgctggtgttcttggccaaccaactcctcttctgctggcctcctccagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactgtgagtatccggcagggcccctcgcccacggttgagctcgcctgcttccaccccagcccatgtccacacctctcagcattggtgtgcgcctttcctaaggatgaggatattctcttacataaccagagcgacgttatgaaattccccacacttcacatttctataattggcagcggtattccagttatatcagccaatgctgcttctttcatttccttgaatctggaacatgaccagatggtaacttgaagtacccggtcaagttttttttctggtttctcctttttttcttttcttttttcttttcttttcttttctttctttttttttttttttgagatggagtcttgctctgtcatccaggctggagtgcagtggagcggtcttggctcactgcaacctctgcctcccgggttcaagcgattctcctgcctcagcctcctgattagctgggattacaggcacgcgccaccacacccaactaattttcgtatttagtagagatgcggttgcaccatgttgatcaggttggtctcgaactccagacctcaaatgttccactcgcctctgtctcccaaagtgttgggaatacgggtgtgaaccatcacgcccagccatggtttctcctttgtataagctactattttcacctttgcaactaataagcagtccaggaagagatcttgagaccatgcaaacacacctctcctcctcaaactgtacctcataaaatatccgaattcgtcttctctgtgtgtaggggcttgggcctggcctcagggctggggtgagagcctatggctctatccaagtcactggtggtttccagacccccaggcaatccctgagctggaaggcattgaaatcctcaactcaagtgccgtgctggtcaagtggcggccggtggacctggcccaggtcaagggccacctccgcggatacaatgtaagggttgaaggcatgggggcccaggagggtgatcactgaggtaaagcgacaggatggtgagggggctttgccacctgccagccgctctcctggaagacttgggttgagaggagggtccccattaagggtggtgggggtgtgcgctgggggccctgctgggtgccttctgcccctgcgaggtctcctgttcgcttgtgcaggtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggaggtgagtcctgcaccccacgcctcatcccctgccctcctccccagacctgggcgaggacctacctgccactcggttctgtgccctgcagtg

SEQ ID NO: 139554 - DNA, 1111 bp, Homo sapiens
ccagctcagggccctctgcagtgtccccagggagccccctcctccctccctggaccttcacactgaggtcttctgcagagacaaagctttcagaggcagcctgctgctccctccctccctcttctcccttcctcgaggccgccctggccagtgctctgcagagtcctggggctgggacagcagctctggcctctgccccagagagcttggtggctgtctgggaggaaggagggagaagaggagggctggcgccaaccccgcaggctatggaaactcagaggcagcagggcctttgggatagttttcagggggagggggcagcagggctctgaaggctgggccctggtaattgaaaacactcagctgtgctaattggattaggagggaagcaggctggagcaggggacggtgccttccaaggcatcctgaatgggtggggtcagttctgcaggccctgccaggccctgccagggggctgcaaggacactccttgttaaaggcaagaatttctctctccctgtctgctagagctggaggcatggcctggctgcctctgggctacatgccctgtgtgtctatccagtggagctcctctccctgggcatctctctgtcccatctccctgggcttgacctgccactgctccagcccagcgtgtgcccccttgttgccactgccagggcctcctctcctgccattccctctccacgggggggctgcaggagcttactatgtcccctgccatctgccccactctggggctgcctgtcagtatttctctccattccctcccttgctgcctgcctggatttctcagatgaaggacaccatggtaagttggggaggggtgagagtgtttcccagaaggccaaggagaagggtaaggaggccctcagctgagcctgcacccccgccctcctgagtgccggggccctgctcggctctccctgagcaccatgtgcttctctcacctgtgtggggctggctttgttctgtctctgccccagcctgggtactctgtcaccctcactgttcctctctgccattctctctggtcccttctcccctgtctggggtttgtccttcttggtttctgtgtcttggcttttgt

SEQ ID NO: 139555 - DNA, 1026 bp, Homo sapiens
agggaggagtggggcaggggccaagccaggcttcacgaacccctgtgagatccagggacacccccaccctcttcctcctgccccacctgcaactacctgtcctaggaagaggggctggggacctccgtgtgctcacgggctccctcccaccacacacaacctcacatgatacagccacacagccacaaacacacaacacagagacgctcgctcatgttcttgaacataccatgagtatggacgcaccttccctgtacctgagccctcctcctccctcccccaacacctctctccttcccctgtccccacaccccctccagcccccatcccagtagttctctttccactccccccgcacccaggcctggcttggctcagccgaggccagcccagcccagcccagcccaaggcagctgctttcttcctgtttgtctgtcttctctgttgcctgtgaagccagagaccaaaacagcctcacggaccaggcccaagtccggcccgcggccaaggcctcctcttcctgcccagagagcctggcagcaccctggcccctcccggccctgttagggtggtgggaacacagggtgggcattttccagagacagcgcacacaccacaccacatacatacatgcacacagccacacgccacacacacatgcacccaccacacacccatacgccacaccacacacacaccacaccatgcacacatatattacacaccacacacatgcacacatcacacactcccatacgccacacacccacacatgtacccaccacacagccatacacaccacatacgcacagccaacaccacacacgcacacacccgcagcacacacaggtgcacatcacaccccgcatctttgccatgtttttgcagagccccttgggggcaggctgcagagtgctggcaccccaggcctgacgcttcagctgcatctcctcagcgcatgcacatcctcatgctgtccccaataaccgcatgctgtcactaatctaggagcatagaaaaggcctt

SEQ ID NO: 139556 - DNA, 1041 bp, Homo sapiens
ccctggcacgcttgcattgtcttgagtagcggcaggccaagttcatggagcacaaactcaagtgcacaaaggcgcgcaacgagtacctgcttagcctggctagtgtcaacgctgctgtcagtaactactacctgcatgacgtcttggacctcatggacgtgagtccttggtgggcaggtgggaaaaggtgcctggtgcctcggggctgggaagctgtggctccaggacctacccaagcatctccttgtttcctcctcagtgctgtgacacagggttccacctggccctggggcaggtgctccggagctacacggccgctgagagccgcacccaagcctcccaagtgcagggcctgggcagcctggaagaagctgtggaggccctggatcctccaggggacaaagccaaggttctcgaggtgcatgctaccgtcttctgtcccccgctgcgctttgactaccacccccatgatggggatgaggtgagggtcaccccctgctgggcttggcattctctggccttcactgtaatggtgggcagtggagtggcatgacccacactttgctcaggaatccaagttctccatggtctcaggcagtgcggcagctagagaagtgtcccacttccatttgcagcctcactccaagggtgcacccccgcaatggccaaggagggcaagacactaactgttcaaaccgtgcagcaggcagccgtgtagctgcccatacattgttctaggctggtttctctgtgtttttaaatttcgtgacacaaacttggcagtaagatggaatggggcttctttatccttctccgtcgagctagtttttcctgcagcagtttatcctgatgggcattgtcaatgatctgggattacattgggcccctttcgggccgacttggaactttacgaagagtccggcatcaccagggcttccgatggcgtcacagctgctccctaacccacccctcccgttcccagctcccacccccagaaacagccacccacctcccggtgtcaagcagccattttccattggc

SEQ ID NO: 139557 - DNA, 1877 bp, Homo sapiens
ccagccgtggaggccgcctggggagcagccgggagcaccaaagcttccggtaggtgatgtgctggcaggggggccacggcagggcccaagctccgctcccaggtctcagtgcccctctacccccaggaaggagccgtccctcctgtcgcccttgcactgctgggcggtgctgctgcagcacacgcggcagcagagccgggagagcgcggccctgagtgaggtgctggccgggcccctggcccagcgcctgagtcacattgcagaggacgtggggcgcctggtcaagaaggtgaggctctcatcctgggccacgggaagtgttcgaggctttgggatcaggaggcactgtggctgggagggcactggaggccaggtggggagcaggcagagcgaacctgtgtgcccccccgatggggcttgatctgggcagagcttccagtgcctggcggggccgctctgggcagtgccgtgctcacccttgcctctgcctctagagcagggatctggagcagcagctgcaggatgagctcctggaggtggtctcagagctccagacggtgaggaaagggctggggaggggcctgccccaatggtccagggagaaatgccactcacagtggggaggaacaccgccagaccatcacatcaccccaagccaggctcagggagaagcacgcacctaggggcaaaggcctctctccctaggcacagggcgttaggctaagtgctcacatgggatcgcccagctctgaggtccaagttccagaggggcaggggtagagggctgggggctggcccagccgtggccttcaccagcaccaccttgctttgggtctccctgcaggccaagaagacgtaccaggcatatcacatggagagcgtgaatgccgaggccaagctccgggaggccgagcggcaggaggagaagcgggcaggccggagtgtccccaccaccaccgctggtgccactgaggcagggcccctccgcaagagctccctcaagaagggagggaggctggtggagaaggtgggcctggagggcacctcagacgcaggcctatgggccatgggccctaactaggacctgctgtgctgagggggaagtcagggctgggtgcaggggagggcaggagtggcaggacagtgccatcaggttccagggattccatacggaaggctcccagggcctgagagagtggggaaaacagttgcctggccctggacagccccatgcagcctctccatgctcccagcggggcccctgcagctctgctgttctgccagccattccgtaaggtttcagaggggggcaagaagacacttagggtgggtgatggggtgacacgcacggagaaagggccttcgaggtgagcccagtacagagagtggggaggctgggaaatgcctggatggagccgccaggctgtgcgtggctgacagtcatggtctctgggactctgggagcagaggagggagtcgagcatctcaggtgttcttaggggaaatgacagagtttggctgtgttgggggaaggtctccctggctgctgtggttagcgtgccagctttagccaggtgcggtgactcacgcctgtaatcctagcattttgggaggctgaggtgggtggatcacgaagtcaggagttcaagatcagtgtggccaacatggtgaaaccccatctctactaaaaatacaaaaattagccgggcatgatggcgggtgcctgtcatcccagctacttgggaggctgaggcgggagaatcacttgaacacagcaggcggaggttgcagtgatctaagattgcaccactgtactccagcctgggcgacagagcgagactctgtctcaaaaaaaaaaaataaaaaaaaaatagagt

SEQ ID NO: 139558 - DNA, 1100 bp, Homo sapiens
ctacgttgccaggagtcacgacctcagtttcctaggctgggctttagaggaggccatctgcctagcagcctggagggtgatgggagaggcagagggaggaggcttttagaagggaagtggggaggtctagggaccagtgggtggcctgcctgctcaaaggtagttctgagtcagggttctgcccaaggctcatcgggtggcagggctggtcaaggggcagcgctctgtcgtgggggcctccatggtagtcggtaagcccaggtagcggtggactggggctccagccaggtgtccccactcagtcccgcgtgtcctgcctagccctgctgcctcactatgcccctctcctcagccagcgacagggccaggctccctttgtctggaaacttaggccctgtctctttgcccccgcttctccctgggttcctggtggcagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactggggaactttgtgtgtgagcgcgcgcacatttagagggtgtgtttctccaggtcctctggtggggatgtgagccttggccttttgacccagagcatcctgccaggcccgagtacaaggaaagagctttggaggtgggactccctagtctcatgaccttcagcagctgtggccccggggaaggaggccctggacttatgggagagaccctgccttggaggtctgcttggccacgctgaatgtgttttgtggcacaagccggggctgctcaggctcaaagctcaacagcagggctcccactcttggtggccttcagttctcttcccaccttcaccttcagactttctctccctaatcacacctgcttcg

SEQ ID NO: 139559 - DNA, 1018 bp, Homo sapiens
catcagggcacctgagaccggctgagttgccttccaggtcgggggtgggccggctgtggggaagaggctgtggaccccagcactgccaggatacctccacattcactcggcggctgatggttgaaaagccggcatggagacagcacctgcctgctgaaacgtgctccatgtgttgtgatggaggagctctggcccatgatggctgaggctggcgaagggcacacgggctgtttagtaatgtttgggaatagagaggtgtgggtccctggcgtgagcagatgctgaggagcaggactcaagcatgaccaagcacctagaagaatccaagagagagcagaatcgaggagaatgcacattcaggaaggaagggccagtggccaggcagcctagtggatgggggaggtctgcctgaggaccaggaggccccgtgtgcctagcacactagagagaacctggcagttggcatgcccagtagacagtggaaaaaagtgcttgcaagtgaagctggggtgggctgcctgtggagggacactaactgcactcagcccgtttggtaggggatgaagaagagggactgttgggaagggcggtggcctctgggctggatgctggcaagagggatctgtgacccagatgacgatgtctggtgggaattgctttatagctaagtcagcaatcctcatgtcttaggcctggcagggccagcctaggccattgagtccagctccccttccagggacatggccacgcgagtctgcacacacacctgcccagtgtagtcacggccccagagctgctcaggcagggctcaccgtctttcctgggttctgatggctgttgtgaggcagctcagtaagggacagggcgcagggcagggagggaaggggaaggctgaattcagggcttcagctcacaagaaaccgcagaaatggatccttagtatccaggctaaggacacagaacgggggcaggacgggtggggcgggccgctgtgtcctggagcctttgctggagagaa

SEQ ID NO: 139560 - DNA, 1432 bp, Homo sapiens
ggtgcctagccatgtgcgaggagatgctgggcgccctgctgagccgccccgcccccgccccctcccccgcccccacccccgcctgccgaggcgcggaataaaggctgagtccgctccacctgcggctgtgcgcgcgtctgtgggctcgcgggaggggggctgtcgcgccgagggaggggccggctccagctccggggcagcgcccgccccgcccccaggcccgccccgcgctgaccggctccgcgcattggcccgccccgtgcgctggcctgtcccgcgcattggccaagcggccgggaggacgggcccggcggccgtgcacttccggccggtggccggcccggcgcgcaccgccccttccgccgtcgcccagcgagcccagctccggtcccagccccggccgtcccggcgtcgcttcggagcgcggcggcagctgactgcgccttcacgatccgctgggacccgcgagccccgccgccgttatgaacatccgcaatgcgagggtgagcgcccggggcgggaggctgtccgcgccgcgtgggcgccgggccgggtggctgccgcgcatgctcccgagggccccggccgagcccggcccggtggccctgagtgtgcctgcggccgctggacctatggggctggcccagcccgccgaagaggccggggcgcggggccggggctgcgattccctcctgtttgcgtgatgtcgggcctccgttgggtgggctccggggacctccggggcgcccactcctgttcctgtgctccgggcgttgtgcaaagtcagatcgtcacagtgcctgcccagccccgagggagcggggccgagcagaccgacggggagcaggcttctcacccgtggtcaccgccgccttagactgagcgcgttccactgccctccttccctgcagccagaggacctaatgaacatgcagcactgcaacctcctctgcctgcccgagaactaccagatgaaatactacttctaccatggcctttcctggccccaggtgggcagcttctgaatttgggcatgggggaaagcaggccgaggaaaatcccatctggccatcttggagggagtggacaagtctgtcagagcccagggggctgtatggtcggtggcgtcctgggtgttttcagctggcagacaggggcaaaggaaaagaaggcgcccgaagggagcagagaataggggcaggatccccactttgcgtcttctttctgggtatgggcagggcacagtgtggcgagggggagaccaagccactcagcccggaggtcatgagccatcacacaactcgccactcgtccagtttgtgtccctctaaagggctcttctagctccgacaagaagttttctcactctgttttcctgtcaccagctctcttacattgctgaggacgagaatgggaagattgtggggtatgt

SEQ ID NO: 139561 - DNA, 1052 bp, Homo sapiens
tatggaggccaccagggagctggcgaaacgctgatgctcagacatatatgccattcgtctggggccctggtgtctattcaagaatctacaggtcaggaagctgatatcactgggaggggtccttcagaacttccaaagatgtcccgcaattcacctccagtagcttgggccaatggagacgcagccaggtctggaaagttgcggaggggagtttcctgctgagatgcctgcccctgctctcccctcagctggagtgggccatgaagctctggtggccacacagtgaagccatgattgccttcctcatgggttacagtgacagtggggaccctgtgctgctgcgcctcttctaccaagtggctgagtacaccttccgccaggtgagagctgcctccttgtcccctctagaggctgaatgggggaatggggggagtctggcccggctgcgctcttgccccctcgctgagcacagtcgctcagctggtctgagagtttccggagccccagtgctgttcgttcagtcaacgaagaagcctctgccctcctagagctcgaattttggtggtgggggcgggaggagcagagtgtaagcaagcagacctaggtggtggtgagagtgacagctgtgggaataataccactggagagggttgtgggggggctctttcctatggggtggcagcagggaagcactgagcaggggccgagtcaatcaggggtgtgtctgagggactgggagtctgggcagggtggggcatgtggcacagcaggggggcctggcagcccgggaggataaaggcagagtgggcaagggacggactccagctgcctggtctgattccattgttacctgggtcctggggcttggaggggagggtgttatgggggaagtctgtagggaacagggcagaagctgggacagcagaggaagctgtagctgtcatcccagccagtgagggctggcccaggtgggagctggtggggacagagggttcacagtctggtggagcagcagtgggattcctgagtctccagttcagacggagagatct

SEQ ID NO: 139562 - DNA, 3657 bp, Homo sapiens
gagcctggcaggtcaaggctgcagtgagctgcctgggcgacaggacactgtctcaaaaaacaaagaaacaaacaacaacaacaacaacaaaaacagaacttgcctcctgtctaccctgtgtggtgacaggtcagagggacctctgcattcaggcccactagctgttccctgtcctgctgcacccctgccccacaggcttggtagggccaaggccctcagccgccctgccggggcccctggtgtagggcggggtgggtggcagccccgttccccctcatcccagaccctccggccatcccagcttttcccaccaagcaggatcttgagaccagagctcccagcaggggccctggagggactggcccattcgagtggagggtcgcggcaggaacaagtgcgggggtcgggctcaaagccccgccccaggcccagcggaaccctgaagaggagggggagggtgagccgggcgcggctgtgtcagctgagtgacagtcacgggaccgcgaccaactctgtctggcttcctagaggagcaggagggatgagcaagggtctcccagcgcgacaggccagtggtggggtgcttggggggagtgctgtcttggagggtcccggggatggtgacgtctgaagccccgtgcagaggtggggagatccctgagggctggttcccgaggctgggggggcctaggtcccatgtgggggctgcgccttcaagccccatttcccctaggacatggagaaagagcgagagactctgcaggcctggaaggagcgcgtggggcaggagctggaccgcgtggtggctttctggatggagcactcccacgaccaggagcacgggtactcggcgtgcttctggagtcctcagcagggtttttgcccttcctgaggccccttctcactctcaggcacctcacagatttgctggccccagaggggcaggaggggctggcaaggcccgttccagactttgctaaccctgccttcccacaggggcttcttcacgtgccttggccgcgaggggcgggtgtatgatgacctcaagtatgtgtggctgcaggggaggcaggtatggtgttcccagcctggaagctcaggcacacggcccatcgcctcaaaggtctccccacctcaccccagccggccacttaagccactttccctcccgtaccccgcaggtatggatgtattgtcgcctgtaccgcactttcgagcgcttccgccatgctcagcttctggacgcagcaaaagcaggtaggtgcccccttcctgcccatctcccagtgactccgtccatgtttactcaacagggcacatgtgcggagttcctagagggatctagaagcagcgaaggacttggggaggctcaagggtggtgtgtgcggggcgtcctggccttacccctggcatgccaaccccccaacctccaggtggtgagttcttgctgcggtatgcccgggtggcacctcctggcaagaagtgtgcctttgtgctgactcgggacggccgcccggtcaaggtgcagcgaaccatcttcagtgagtgtttctacaccatggccatgaacgagctgtggagagccacaggggaagtgcggtaccaggtgtgtgagaggagggtgcccctgaagaccccaccctgcgaccctgccatggccacctgatgcattcccactcactacgcaagtcccctcccatggacccatctgtgggccaagtccccttcacctctgaacgctcccctacccccacaggggcgcagacggagagggccctatccacgccctgcccccaactgggaaaaggcccttccctcctccctgggctccctgtgctgccagaccctgaccccacagcctggaaggggctgcacccccagactgggagcagagtggggcggatctgactggcccctactggacgctgggtgccaggccccaagtaggccctggatgaaggtgtctctgggttcaggagaggaattggctctcccaccccagggccgtgtccagggggatggcacaggatgtagcctcagcctgggcctccccttgcctcctgcacccccagacggaagcggtggagatgatggatcagatcgtccactgggtgcaggaggacgcgtcgggactgggccggccccagctccagggggccccggctgcggagcccatggcggtgcccatgatgctactgaacctggtggagcagctcggggaggcagatgaggagctggcgggcaaatacgcagagctgggggactggtgcgcccggaggattctgcagcacgtgcaggtgggggatgcctggggagctggggtggtgggaggccttccactcccccactcccctgggcaccctggggctcgacacacctggagagacagagattcggggatgtcccacctggggaaggtggagggcctgagggctggagggaggatgcggagccccaggcaagccctgacagaaggagacccctcctgccccacccaagtcccttccaggcctctgggccgtgaaacccgccctgtctgtccccattcaatgtttcaccctcccctgctggagaggatcaggccagaagtgaggattacatcttcctaggcccgggctggacgcggtggctcgtgcctgtaatcccagcagtttgggaggctgaggcgggcggatcacctgaggtcaggagttggagaccagcctggccaatatagtgaaaccccgtctctactaaaaatacaaaaattagctgggcatggtggtgcatgcctgtaatcccagcctctagggaggctgaggcaggagaatcgcatgaacccaggaggtggagattgtagtgagtcgagattgcggccactgcactttagcctgggtgacagagcaagactctgtctaaaaaaaaaaaaaaaaaaaaaaaacaacaacttgctaggcccaagggagtgaatcagcccctccttaaatgcccctctgagcctggcccacccaagccagcaggtccaggggcttgggtaagagggagggaggaagggctttccggagctgggtctttctagttgggtggctgggtgggtgaaagggctggaggcaacattcccttctgctccttcccggtagagggatggacaagctgtgctggagaatgtgtcagagggtggcaaggaacttcctggctgcctggggagacagcagaacccaggtgaggggcggggtgggctgggggccacccaggaggaggggagcgctgagccttgtgttctgggcttcagatatgggagtgcctggcgggggcgccttgaggaggcagaggagcgaggatgggcttcccaaggctgggggtttctgcagaggagcaggcttccagggccagggagctcagagcctcgctcattgttagggagggagcagagaggtgccaggggcttttgctccctctgttccctccctcaaccccaccccccgccccccgcccttccgtactccacccctcaccaggccacacgctggaagccggctggtttctgctccgtcattgcattcggaaaggcgaccccgaacttcgagcccacgtgattgacaagttcctattgttgcccttccactccggatgggaccctgaccacggaggcctcttttacttccaggatgctgataa

SEQ ID NO: 139563 - DNA, 1061 bp, Homo sapiens
accgcctcccaaacagggctgctggtttccgcagccactgctccacctcccccaaatcgtcatggaaagggtggagaatggaggggaaccaggcgtccttggaggcagcttgggagggtgactgtgtagtgtcacccacaagggaggctagggcaatggagcaggccaccagcagcagctgtgcagcatggaactcaggccaggctccgaggctgggggatctgcttggagttttctgccccccaccccaaacttctgtcgaggagcaaggcttgccagcaagtcagaaggatttgaaccgagcagccaatctttccagccctcccctaccgacctctgcctggagacgcagcagcctgtgtcctccagggcctctggtttgttgtattatagtatatttcgctgtggaaaatgtcacgtttagtcaccttggagcccactcacctggtcctgttgttttaccccatcccttctctcgcgcgcctattgatttgtttctgaggagagtacaccgttcactattgtagagtaacccctgtgactcaatattaccatagtgcgatgtcgttttgtgctattttgaacaattaaaagactttttttgaaataaccactaggtgtctcactgtgtcccggcatcctctcaggaagcctgagcgggaaggctgagacctgcccgaggctcacgggagccccctggagggagacctgagctctggtgaaagcgtagaaggccccagagtgaggcctctgctgtggcctccggtctttggaccaagtcggaccagggtccagcaggttgcttggtagctgccttgcagggcaagggccaaagagccccttgggcagctgctgctgacttcctgtgtctggggcccagatctccctccctcccctcctgcactagaggataggatggggcaagggcctggcaggtcaccagcggcagcctccttgggtgggttggggggaggtgggctgagtcaagtacaccacgggtactgcagaggtggatcccttcctctggcttcctcttaaatgtgagccatgcccccaaggga

SEQ ID NO: 139564 - DNA, 1829 bp, Homo sapiens
cccacgggggtggccatcaagtagagcaggggacccagctccgggcctgggggtgcaggggacgccaccccaggatgtttgaggggacaagcagtgagagggctggcgggaaagtgtaggtttccaggcccgaaaacagcacgtcccaggtccctggagtgcagcaggtgagggatggaggccagcctgcctcctgtcaggtcatgctcctgctccagctcccctggggctctgggacctgggagggcagtgagaggtgggagctgagctgagtgggtttctaacctacgtccagaggggagtgagtggtgtcgtgttctggtcccaaggagtggcgtaaaaggtgaccacccatagggcaggcgccccacccttgccagctgcgggtcatgccatgtggcaccaagagactctgcaggcgggcagggcgcatgtgttccttgctctcgttctgtcacaatgctgctcacgcatctctcccgttccttccagaaaccagtaaagacagctctggcaccaagccagccaacaagcggcccatgtcctctccagaaatgtaagcaggaagcccctctcgggaaccttctgagactaggggtggaaatagctgggttcagcctcttgtcaaatgactgggggcccctaaccggccctgcaccagcagggcctccagtggtgcagggcccacactaactttctctttcctttttctgccttccaaggaaatctgctccaaagaaatctaaggccgatggtcagtgagaggaagctgactagcccctggattcttctccagacccccctgcttcaggaacacccgccagggcccacccctcccaccccgtcccagcattcgcacttcaccctcgcgagccgctgttcactcctctcccctttctctttctctctgtttttaaaataatctaaagaaagcacattttaccattgctgttgggaggaagcagaggcagatgggaaagcagagagaggagcgcgcttcctttcctccccgctgccgcccaccctggggagagacttttgcggggagggaaggcggagctgaggacagccagctccgccctcccaaggctgtgcgttcctgagggccaggtcgggggcaggcatggaggggaggaaaggcgtccctcttggccctccccagagtggctttcctggcaccctggcctgggtgtctggttctgttttcttttcttccccttgtgtttccagtcacctaacttcccttcctcaggctcccccggcccaccctgctcagtgaccccacaggaagcttacacattttctcagaggcctttgtgctcccacctcttctaccctccccctcttctttcccattttaaaaaagaaaagaaggaaaaagaaaaaaggggcaaggagccccgcggcggcctgggcagcgcctgtgcagacctccctgcaggccgcactgccaactgctgcatttgttgtgttttttaggttgcaattggtgaagttcacactttcattgtaattttagcgtgtggggttttgtcccttttttgttgttgttagctgtgtacagaatgtgtaatcttttttcttttctcttttttttgttttgttttgttttgtttttgtttttttacttttttcttcttggctaattcttggcagggatctttctggaggaaaagctggggccagccagggcaggagaggtgtgaaatctgccacgaggggcctgctgtttgccacccagcccaacttcctgttgctggcccctgccctctgcccttttgcctgtcctcaggccgctggaacaaaggaaggacagctcattcctcatg

SEQ ID NO: 139565 - DNA, 1028 bp, Homo sapiens
ccaccaccctgagcggggcttacaggaaactcctccatctttgggccaagctgagtagccaggaagcctgaggaaggtgggcagagaccatcccccctgaagcagtagaaaaggagagctttggttccttcccgccagtaccgggccacagtcagcctcgccacgtccctccttgccgtgaggggccagccaccgctgacctcttttccctctggcccatagttaccatggacctgcagtgttcctggggtggcccagagctgccttctccacagtggcgttcatgccactcctcttttcctaggatgatttgggcaccgtccctgactataaccagctgaagaagcaggagctgcagccaggcacagcctataagtttcgtgttgccggaatcaatgcctgtggccgggggcccttcagcgaaatctcagcctttaagacgtgcctgcctggtttcccaggggccccttgtgccattaaaatcagcaaagtgagtcttgctgtggggtggccgtctgtccctggttggtttctgcctgcctcagcacatgaggtggccgggggggggcataggagagctaggttttgagtcccagtttgtcttagtccttccacttgggggaagatctctttgaagctccttgaactaccacatggaatatctctactgtgttagaaaatggcttatgggaaccatgattagtcagttctggaagcctctagcctgttctgttgaccttctgaccccctggcttctagagtccggatggtgctcacctcacctgggagccaccctctgtgacctccggcaagattatcgagtactccgtgtacctggccatccagagctcacaggctgggggcgagctcaagagctccaccccggcccagctggccttcatgcgggtgtactgcgggcccagcccctcctgcctggtgcagtcctccagcctttccaacgcccacatcgactacaccaccaagcccgccatcatcttccgcatcgccgcccgcaatgagaagggcta

SEQ ID NO: 139566 - DNA, 1902 bp, Homo sapiens
ggagagcacccagggcgacagcgtgaacatcaccagctccagtgccatcacgacaaccgtgtcctccacactgacgcgggctgtgaccaccgtgacgcagtccacaccggtcccgggcccctctgtgccggtaagagcccagggggccgtgttcttccccgccttcccggcctacgcccgtgcagttccacactcagacgccagatgtcgctcttgtaccaggcatggggccgctcctggtcccttttccggaccataaaagggcagcctcggtgcctgctgcggcaggaggcaggagcctcaccgtcccccgcatctctggggcgcttttatttctgggactggttctcatcgcgtgtcacttcaccgcagcctgtataagacatggcgggggtctgagtgcccatttgtccaggccagggtgactgaggacgggttaaacctgaccgggggtctcaagggcctttctcctcatgctggtcagagaaccactgtcccctccctatttaacatgggctggagctggcccatcaagaatgaaaacttaggcccacaaggaaaggtgagggctggcttgcttctcagccctgctgcctggctctggcccctctcctcccctctgacaggggcttctctccctttctagaagatctcatcaatgactgagactgccccaagggctctgactactgaagtccccatcccggccaaaataacagtgaccatagccaacacagaaacttctgacatgcccttctctgctgttgacatcctgcagcccccagaggaactccaggtgtcgccaggtcctcgccagcagctgccgccacggcagcttctgcagtcggcttccacagccctgatgggggagtccgccgaggtcctgtcagcctcccagacccctgagctcccggccgccgtggatctgagcagcacaggggagccatcttcgggccaggagtctgccggctctgcggtggtggccactgtggtggtccagccacccccacccacacagtccgaagtagaccagttatcacttccccaagagctaatggccgaggcccaagctggcaccaccaccctcatggtaacggggctcacccccgaggagctggcagtgacggctgctgcagaagcagctgcccaggccgcagccacggaggaagcccaggccctggccatccaggcggtgctccaggccgcgcagcaggccgtcatgggtgagtgccggtgcaaccctggggaagccgggccgctcgggggagcaataggccgcggagacagcctgggaagaggagcccatttccctcgagggtggcatgagccagatgtgatggggaggacgagcacaggggaccccaggcaggccaagtagtagagactgccgtgtagaacaggctggctggggttagcgcctgggaaacaggcagggcccctcggccagggcttagcctacagtggagcacggtaggaggtggacggggtctctaggacaggctttgggggcctccgcccgggctgcccgcttctggccagccttcctagtaagtagtgtttctctcgaccctggagcaggcaccggcgagcccatggacacctccgaggcagcagcaaccgtgactcaggcggagctggggcacctgtcggccgagggtcaggagggccaggccaccaccatacccattgtgctgacacagcaggagctggctgccctggtgcagcagcagcagctgcaggaggcccaggcccagcagcagcatcaccacctccccactgaggccctggcccctgccgacagtctcaacgacccagccattgagagcaattgcctcaatgagctggccggcacggtccccagcactgtggcgctgctgccctcaacggccactgagagtaagc

SEQ ID NO: 139567 - DNA, 1047 bp, Homo sapiens
ggacaggcagacagccagctgcagcactaactctcctcctcgtgtgtctccccagcccgtgtcccagcccacccaggtaactctgatcacggcacctagtggggtggaggcccagcctgtgcatgacctccctgtgtccattctggcctccccgactacagaacagcccaccgccacagttaccatcgccgactcaggccagggtgatgtgcagcctggcactgtcaccttggtgtgctccaacccaccctgtgagacccacgagactggcaccaccaacacggccaccactactgttgtggctaaccttgggggacacccccagcccacccaagtgcagttcgtctgtgacagacaggaggcagctgcttctcttgtgacctcgactgtgggccagcagaatggtagcgtggtccgagtctgttcgaacccgccctgcgagacccacgagacgggcaccaccaacaccgccaccaccgccacctccaacatggccgggcagcatggctgctcaaacccaccctgcgagacccacgagacgggcaccaccaacactgccactacagccatgtcgagcgtcggcgccaaccaccagcgagatgcccgtcgggcctgtgcagctggcacccctgccgtgatccggatcagtgtggccactggggcgctggaggcagcccagggctctaagtcccagtgccaaacccgccagaccagcgcgaccagcaccaccatgactgtgatggccaccggggccccgtgctcggccggcccactccttgggccgagcatggcacgggagcccgggggccgcagccctgcttttgtgcagttggcccctctgagcagcaaagtcaggctgagcagcccaagcattaaggaccttcctgcggggcgccacagccatgcggtcagcaccgctgccatgacccgttccagcgtgggtgctggggagccccgcatggcacctgtgtgcgagagcctccagggtggctcgcccagcaccacagtgactgtgacagccctggaggcactgctgtgcccctcggc

SEQ ID NO: 139568 - DNA, 1056 bp, Homo sapiens
gccgctgacccaagtaggcatcacgctcctgccccaggctgcccccgcacccccgaccaccaccaccatccaggtcttgccaacggtgcctggcagctccatttctgtgcccaccgcagccaggactcaaggtgagccaggggaccagggacgtttgaaagtagggggctagcctccggggagaggcagcggccaagtaggggctgcgagacggcagcctagacagcaggccagcagccgggagctttgggcttgtctccaagggttgtagggggatgctaaagcctggccccacctgtggaaatggtcactctcagggcacagagaagagccagactcccacacaagcaggccaacagaagtggctcagggctgcctgcaaaggggctggggacatcgtgcagaaggtgatggctgacggctggccccttctctcatcaggtgtccctgctgttctcaaagtgaccggtcctcaggctacaacaggaactccattggtcaccatgcgacctgccagccaggctgggaaagcccctgtcaccgtgacctcccttcccgccggagtgcggatggttgtgccaacacagagtgcccagggaacggtgaggagtggtcactggggcgggtgggatttcctgttgatccagtggattaagttgcaagtgtactgaggggttcacatccctctcgggctctggtaccacgcaccccacacctttccctcctgggacgtgcagatggggaaacgctcctgcgaggtcatggtgggaattaataggttaatgcctagaaggcctaacctgctgcctgatcctaagagcatttgccacgtggactttcttgtcctgcagcctgagaggaggatctagccagctgggcttgccacaggcccatgagaatcaacgggacctgactctggtctttagaaaggatccagagctcccagctgcctcttgccacgggggttgccgtgcatggtgggtggtgggagccctctgtgtctggggccaggagagcggggtctggcagtagagaaagctgagccatgctggcggg

SEQ ID NO: 139569 - DNA, 2225 bp, Homo sapiens
gctcattaagatgaccttggcgagaagcagggtggtcacaggctcttttgcactggcctgaagtcgaggggtttggaagatggcccaggtagcgcagctggagttgctagagcgcccgcagggatggtgctggctcagcccctctcaccaagcttgacggctggcacatttggggaatgagaggaatgggggctcccgggtgttctgacttctgcctccttctgttccccagcaaccaaccagtggttcatcccagccgtgaggggggacattccccctgggtgtgcagcctatggcttcgtgtgtgacgggactcgcctcctggtgtttggtgggatggtggagtatgggaaatacagcaatgacctctacgaactccaggtaaagcagccccaggttctcactctgcctccttggccccatgtgacctgacggtagtggcttcagggttgaggcaagcgggaggtggaagggacgcttgagagtctgccaaggctgctctgaacttggcccacctcagaagaaggcagcaaggaccaacacccaggaccttcttgctccagcaaggcacctcgctcacccccggccatttcctcctccaccacaagttgccccgggtccctagtggtggccttctcatcccacggttcagtctccaggtcttgattttgcaggcgagccggtgggagtggaagagactcaaagcaaagacgcccaaaaacgggccccctccgtgtcctcgactcgggcacagcttctcccttgtgggcaacaaatgctacctgtttgggggtctggccaatgatagcgaggacccaaagaacaacattccaaggtgaggcttggtccttttctctggaaccccccgggtgggtgtgctctcacatgcacagggctccatggtgtcctaaagaatgtgcgcagcagagccccgtggccgggtccctttctcgtgctgggttgtaaatgagagagcggcaccggatgccctctcaggagctttcgggctccaaaatcgctactgaccctgagcaggcctcgtgggaggagggccaagctggaggtggaagccactttgccttgggctggcccagctctcggagtcggcttagagctgctcgcgttccttctcagcctccgctgcctacaagtttcctgatgggtattttccaaggcccgtggccaaggactctctgtctggaggtagtcccaagccagcgccccctcttgctctgcggagccctcatataatacccagctttgtgtgcatggcgggggcctgctgctgggtctggactcggggctgctgtgcagcctcacccaccctgtgtcccctgttccagttggactcatcctagggagcttctggcagccccttcctcaagagctagggtagaagaacttcagagctcccacagccctagcccctttgtgttctggggaggctgccactcactgatagccatccagcgaagcctctggcgtgaggagtcgagacttgccgtaactgatctttcctcgtcaggtacctgaatgacttatatatcctggaattacggccaggctctggagtggtagcctgggacattcccatcacttacggggtcctaccaccaccccgggagtcacatactgccgtggtctacaccgaaaaagacaataagaagtccaagctggtgatctacggcgggatgagtggctgcaggctgggggacctgtggaccctagatattggtgagcagggtggtagcaccccagcagccatgggacaaagcgggtctgcctcttggctggccccgtgggtggcgctgttgtatggtgaggtggggctcttagggagctggagcataccacttcgtgctttcctcttgtcatggtgggccagggtggggaaccctggatcgtccctaggtttggggctgttatctctgccctgtgctggctgagtgggctgaattggtctgcgggcttataagagaataagtcattaaggctttctagaatggaattctctggatccgggtagcattagtccctcttgactcgtcagtggtcagactgtgtggagtgctgcatcctggtctgactgctgtggtaccattggatgccggtaaaccgtgaggccttcggggactgcttgggccggtcaccaggtggtggtatcaggagtggctgggaaagattactaactgtggatctccggaggcctcttcagctgggagaga

SEQ ID NO: 139570 - DNA, 1907 bp, Homo sapiens
cattctctcctctgtccctgtatctaattgttcattgcgttgggcaggcatcaaatgtgtccccttccacaccaagccctcctctcctcttactagactcttgcagtcacttcctgattggccctgctagtttcatttgtcgggaaatcctgttcacccttcaaggcccggctgaaacgtcacctcttctgagaagccctttccactcctgtcctcccctctccagcagtcgcactgctctgtgctcccaagggcccggcttggtcagagctcttctagggtgtttgtctcatcgtgggaggggggcatgcagccttcctaccccattgggagtatgagcacaagatcggtgtcctctgtgcctcccagcacgtcgtatgccacacaggaaatgctctaatgtgacaggtagaacagagaggaaggcagctcgttgaacttgaccggccacctcactgcatgggcaccagtctctaggtggtgatgggacagtggcaaccagggatggagcttgcagagcatgaagtggttgggggagctgatgaaacacagagaggccggggcacagccttgctcaggagaggggagctggagtggtcttcatctagtgcagggtcctttccccaccttcccctcccagctgagagccagcatttccaggatgaggggcccaaggattgggttacatgacaccccccagatgattcaggggtgactgagagcagctgtcacattgaaaagctgggagaagggaggagagcttgctcgtgtgctttcagggggcggaaccaggactcgtgggtgagatgaggagccgcaggtttgtcgtcacaccaggagctgtgctccctgacagacctctcttgacgggggtggggagggcccctgccctgcctggagtgttctagaatgagatcagcacctcttgggtcctgtagaaggatctggtgagcgggatccccaaagatatcacagggcgcttctggcctggcccaccggctcactgatcagcgtgtgataggaaagctgcccactgaccccacgtgccatttagctttgtcccaaactctgacccgcagccccatagctgtgggctttgaccacgagggtgctcaggggagtgagggtggctgcctggacatgggaccctagggaaggcacagatcggttgcttcaagtcagtgatggggctgttgtctctgtctctgttttacgctgtgacctcaggtgtcgcttgccctcctgggctctgcccctttacctaccgagagcagttggcccaggcagccttaggtctcgttatgcgtttaccctggtagcttgcatggagctccctccagggattggtcaggacggctctccagtgcgcaaggctgttggccttggcagctcttgcttttctggggtggtttttgcactgggaatgagaaagaggcagagggccaggatccgagcttgcacatgcgggcggcacaggtgttgtccctctgctttagggaaatggcaggggagctctagtgctcggcatgtccgaggcccagtgactcagctgaatggctgcagaggctgtcagcctgctcgaagcctacccgcagagtgggtgctggagagcggggtgggggtgctctcgcctcaggaggagcggtggtggtacagttgtgctgtgtggggttttctgttttttttgtttgtttgtttgttttgaggttaggtcttgctctgttgcccaggccgggatgcagtggtgcggtctcagctcactgcagcctcaaactctgagggtcaggcagtcctcccgcctcagcctcctgagtagctaggaccacaagtgtatgccaccacactgagccagtgttttaaaattatttgtagagacggggtctccctgtgctacccaggctgggagt

SEQ ID NO: 139571 - DNA, 1613 bp, Homo sapiens
ccttctcctgcgcctgctcagctctccctcatctcgagtgcccattctggagaaatgaccatttctagattacagattcgttctctgtctctcgaaaaagggagggaagggaagcgctcttaggacgcagagtttaacatccgccgacccgggtaatgccggagccttggggacccctaggacgggccggcggcagggccgcctctccctttccacgtttacttctgcagcatttctttccaagtcgccccttctcctaatctggtgccttctggtttacaagctgaattccagttacccctcagcggcctgcgtagtcgtgtgtctccccgcttctgcggatccagggggttaccccacccgctcttctgcctccctgcaaaacccaaagcccgttagttgggaaggggaggaacctctctcttcaggtatggctgatgcaccacggccttcgtgggggccgtttgttgttgcctctgcctagtagccttgcttagtctctagggcagaaagcctgctgctgtccacgacagctttgtggcatcctttttcttggtggctacttggcccgttttgtgcccctagcacaagggtcagttcccaagttgcctactgactgcccgttggcccacaggaccctggccttgcccagaaggcagggtcagggtgagttcggtcccaggcaagagctggaagagtctgggtgagggaaaagccccctgcaggcggctgggggagggccttgggatgccctagtcctgagtggcaggcacggctcccagcactaaccccttgctccgcggccgttctctcctgggggctctagcgatcccctggcctcggtggtggccctgcagacaaaccctcgctgagtgggctttgtgtcctgagcggtgagaggctgctgttctttggctgagctccagtgcctcgatgctctgggggtgggaagctggagctgcctggagggagaaagttggtttagggagttgggaaggctggagctgggctcttgggtgccgcttccttccccaccccccaaggcagaaagtgctggtttctccacatctcggagattatcgccacctaccacgttgactttgaaaggctggtgggttgtctgtgaccgtttttcgttccaggtctctcagcacctgttgcctccagggagcagggcctttctcagcagcccccgggcgggggcgcttggtggttggtggtgccccgcgccagcccaggcagctgcagtagcaggaattagctcagtaagctaaggcttctccagtggtggggctgtttatagaggcaccgtcaccatgagcagcaccttctccactctgtggaccgactttcttctcataaggcctggagcaggctccctggcagggaaatgcaattttagaaagtagggcaggggcctaattacagtcggctccagagtccaccaccactgctgccttggcttcctggggcctctgcatattcattagtttattaaaatgaattgaccactttggcatgaattcattaccagtctgcaaagacaggttgtgcattagaggggtagcctgccttccaaagggctgcttaaaatgaagctctgggatcctcca

SEQ ID NO: 139572 - DNA, 2015 bp, Homo sapiens
atttccgagatgccgccgccgccatctttgttttgtgctgaaagtcgctattgacgcccgcggacggccgggcgaggggaagtggcaagatggcggctcccagggcggaggcgtggaggctcgcccggtgggggggccgtggggcggggcgcgcctgcgcctgcacctgatctgagcgcgactcgagctttagcccagcgcgcggcagcgccgacccccacccccgccgcgaggcagcgcaggggtcctttaagaggcttgggcccaggggcgaagcggtgcgagggcgagtggggggaagcggtgacgtcacccggctccgcctcctcgcccgaccgccggcgccgctgccgccatgtttagttgttacttcttcacacaagatggcggctcccagggaggaggcatgagcgccctgccgttaccgcttcttctgccgtacagttgccgcttcggggcctaactctagctctttgaagcggctcctgtgggaaggagtcataaggcgggaagtgaggatcggacaccgccttgagtttggtgtgcagtggaagaactgacctaggaggaagagaataggggggaacggggagctagtctcaagatggcggctcccacggcggcaggcgcagcctgagcagcagaggcggactaaggggagaggcgcgagacttcacaagccgtacggcgcgagcccccaaacggccctcgagagctcgagctggttccaccggcctccggcccgcctccattcgttaggtgtgtcgaggctgtttcgggagcggcggctgcactaaggcgctgggcggggaagcgggacggtctcaagatggcggctcccacaattgtggtctgagcgccggcggggctgcgacgaccgcggcgcttgtggctcctttccacccgccccggaagccggccagtgctggggacttgggggtgtgggaaccgggccggggctccgccatttccggcgggggagggctacgactgaggaagggaggagagagaggcggctcaagatggcggctcccagggcctcccgcccgagcttgtaagcgggagcgcccggacaagtagtcggggcgacgggactcagcggcctccagcttcttgagcctaggcgctcgacagtttcgggcggctcttgcggagacggggtgagcgagaagaaagggaagagccaaagggaaggagggcagttaagatggcggcctccatggagtcgtctaccgctgtgtgagaaaccgcttctccgtgagagctgccttagacgaaagggggtgtgtgaaaggaattgaggggctcccttcccgcttgttgacttctccccaccgcaccctttcccggaactatggcttcggccgtgtcgcccgccaacttgccagcggtgcttctgcagccccgctggaagcgagtggtgggctggtcgggtccggtgccacggccccgccacggccaccgcgccgtggccatcaaggagctcatcgtggtgtttggcggcggcaacgagggaatagtggacgaactgcacgtgtacaacacgggtgagtgcaaagcccgctgggtcttcggctctttccctccctccatctcctccctctccctcctctttcctccctccctccatctgctccctccctctcctccctccctccatctcctccctcaccctctacccttccctctctctctcccctcctcccttacccgtccttctcccctctccccgtccccctcccccttctcccctcctccccctccctccccactgatcggcttgcccctcccctttgctgtgccgggcttcagtgcttttctctgatcttctccccgttcccttgtctctcccgtgtttgaggattggttttcgttagttaaaagaaagcccctagtccgactggtgagggagaggggctgtcgccagcggtggtgacttcagacccacaccgttacccagcgggctggggctggggctggggcgggcggatgtgtccccttggcgcaggcagagc

SEQ ID NO: 139573 - DNA, 1578 bp, Homo sapiens
gaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaatctcgggctctacttgtggactttgttgcaccgaaagccttgagctttcctgatgccttacacttcagggttcttgagcgtccagggtcttgttactactctgggctggccacacccagcacttcccgtgtcaggtttttcctgatgtagtccatgttttttatgctattctaaatggtatctttgattttctagttcatcatgatattatacagaaatgcaattgatgctgggcacggtggctcacgcctgtgattccagcgctttgggaagctaaggcgggcagatcacttgaggccaggagtttgagaccagcctgggcaacatggcgaaaccccgtctctacaaaaagtacaaaaattagccaggcatggtggtgcatgcctgtagtttgagctactcaggaggctgacccaggaggatagtttgagcccaggacgttgaggctgcagtgagccatgattccaccactgcactccagcccgggcaacagagggagaccttgcctcaaaaaaaaaaaaaaaaaaaaaaaaagcggttgagttttgcatatgaaccgtatattctgtgaccttgtttaaattcttttttttttttctttttttgagatggagttttgctcttgttgcccaggctgcagtgcaatggcgctatctcagctcactgcaacctctgcctcctaggttcaagtgattctcctgcctcagcctcccgagtagctgggattacaggtgcccaccaccacacccggctaatttttttgtatttttaatagagacagggtttccacatgttgaccaggctggtctcgaactcctgacctccagtgatccgcccgcctcggcctcccaaagtgctagattacaggtgtgagccactgcacctgtccctggctgtctgtatatttacttttttttttgagatggagtttcgctcttgtcacccaggctgcagtgcaatggtgcgatctcggctcattgtaacctctgcctcccaggttcaggtgattctcctgcctcagtctcccgagtagctgggattacaggcgtccgctaccacgcccgactga

SEQ ID NO: 139574 - DNA, 1063 bp, Homo sapiens
gccccctgctgggcgcactgcactactgcatctgcctttttctgtcccctccctagtaccccacctcttctcctctggtgacagttgaaaatggagaggccccgtttgagggcagcggggcagtgagattcattttgtagaaaagaacgaggccattctcagtccttgcttttggcagccgcgcttctcagcactccctgtgatgggaacagaggggcgaggggcagagcgttcccagctgcagggtatgtcattttagagccctggggcaggtcacggacggcctggagcagccctgtggtttgcccacggggtgaccggccagggctgccatctcaccctgagagtccctcttttccacttgcaggtgtacgagaggctagagaagctgcaggcagtggtggcgggggtgcccgggcattcggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggtagctggggagacgggttcccaggagagggaccaaggcctctttgggccaaagcccctgtaagtccccaccccagccttctagaagagaaccagggccaaatgttcagctcactgtgaccttagcaaccctggtttcccctccccaggccacatccttcccaggtggagcttgctctccagccctccccccaccccattcctgaaggctgggaacaaggagggctctgtctggtagcctgagagctgggccctgcccttggacttctctgaggaattcaggcctgaggccagggaggcagggtg

SEQ ID NO: 139575 - DNA, 1024 bp, Homo sapiens
cacctcccgggttcaggcgatcctcctgccgcagcctcccgagtagctgggactacaggcatgcaccaccacacctgcctaatttttgtatttttagtagagatgaggttttgccacattggccaggctagtctcgaactcctgaccccaggtggtctgcgcgcctcagcctcccaaagtgctgggattacaggcgtgagccaccacgcctggcccgacccaatgttttctatagagctctttcccaggcctctcccctttgcaagcagcgtagctggagggtctcatcagcaagccccggaggcgagggggtctggggctaccagctggaccacctacagctgagggagggcccccttgcctcctcctgcatgctgcgtttggggagagcgggaagaatgccttcaaggacttcccgaccaccagggacaaagggatgagccctgggagccgaagcccagcagattctattgaacgtgtccccagccattgcttaagaagtgcaggtcacggagactttgctcctcgttttccagaagggggaaactgaggcctagagagtgaagtggctgttccaggctgcacggtgacaggtagaaggatggttgggatcaaggaacggccatccagcaacctcccctgtccccctttgccaccccagacccaggcctgcccacctctctcctggcctcagcgactggacatccttctgggtacagcccgggcaattcagtttctacatcaggacagccccagcctcatccatggagacatcaagaggtgaggaggggcccttgagaactgccggggcagggcctgcagcaaggggggccccgcgtcctatcaatgtggggatcaggcatggcctgggacctcaacaccccggcatcgcacaggtgtgggaacgggccaaggatgggccctactgatgagcagaggcccccaggcagctggagcgctcagggcagtgccagcgctttctgtgggcaaggcaccgggctggcagcctcgagtccagccttat

SEQ ID NO: 139576 - DNA, 1051 bp, Homo sapiens
tctctgcctgcctctcactggtgtctttatgaagcttttccaggctcccagacccattcagggcctgagctcggcctggtcccaagccctgcttccctgtggcctccaccgccatctccagccccttcttctaccaaggtaggtgtcccctgccccccagggaagattcgagacaaggaggaaggaattcagcctttgatgtagcgcagagccccagtcagccaagctgggtcagctgggaggcagctgtggtggggagagcctggagccttgggcagaagggaagagacagggaccccacctgatccaggctctcttcccacagccaggcccagagagctcagtgtccctcctgcagggagcccgcccctttccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggaggtgagtgtcgcaccctggcagggaccctggaaggccatcagataaccctcaccacttctccagcctttccccctcgcttccccacacaactccttcagccctcattctggcgtagggtccctggccccttggtggttctgggcctcgggtaggtggcactggtggcccgaaggccttcgcttcgagagcctcacgctgcccgtcttccctgccccttcccccaccgcaccctgggggctgcagaacgctgacctggagtggactgcagtgaagcagagcttcctgaccgaggtggagcagctgtccaggtgaggccagagggggagccacaccaggtcccgtggggcttcagaccgcacaccacaggacctggctcccttgggcacctgaggcctggcaggcccgggcgagctgaggccccagccagggctgcccacccagtctggcctgatggaaagtgctcccctttttcaaacaggtttcgtcacccaaacattgtggactttgctggctactgtgctcagaacggcttctact

SEQ ID NO: 139577 - DNA, 1285 bp, Homo sapiens
aaacagccataggccctttcagtggccgggctacccgtgagcccttcggaggaccagggctggggcagcctctgggcccacatccggggccagctccggcgtgtgttcagtgttagcagtgggtcatgatgctctttcccacccagcctgggataggggcagaggaggcgaggaggccgttgccgctgatgtttggccgtgaacaggtgggtgtctgcgtgcgtccacgtgcgtgttttctgactgacatgaaatcgacgcccgagttagcctcacccggtgacctctagccctgcccggatggagcggggcccacccggttcagtgtttctggggagctggacagtggagtgcaaaaggcttgcagaacttgaagcctgctccttcccttgctaccacggcctcctttccgtttgatttgtcactgcttcaatcaataacagccgctccagagtcagtagtcaatgaatatatgaccaaatatcaccaggactgttactcaatgtgtgccgagcccttgcccatgctgggctcccgtgtatctggacactgtaacgtgtgctgtgtttgctccccttccccttccttctttgccctttacttgtctttctggggtttttctgtttgggtttggtttggtttttatttctccttttgtgttccaaacatgaggttctctctactggtcctcttaactgtggtgttgaggcttatatttgtgtaatttttggtgggtgaaaggaattttgctaagtaaatctcttctgtgtttgaactgaagtctgtattgtaactatgtttaaagtaattgttccagagacaaatatttctagacactttttctttacaaacaaaagcattcggagggagggggatggtgactgagatgagaggggagagctgaacagatgacccctgcccagatcagccagaagccacccaaagcagtggagcccaggagtcccactccaagccagcaagccgaatagctgatgtgttgccactttccaagtcactgcaaaaccaggttttgttccgcccagtggattcttgttttgcttcccctccccccgagattattaccaccatcccgtgcttttaaggaaaggcaagattgatgtttccttgaggggagccaggaggggatgtgtgtgtgcagagctgaagagctggggagaatggggctgggcccacccaagcaggaggctgggacgctctgctgtgggcacaggtcaggctaatgttggcagatgcagctcttcctggacaggccaggtggtgggca

SEQ ID NO: 139578 - DNA, 1055 bp, Homo sapiens
gttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcactgcctccccaaggccccctgcctgccctgtcaggaggcagaaggaagcaggtgtgagggcagtgcaaggagggagcacaacccccagctcccgctccgggctccgacttgtgcacaggcagagcccagaccctggaggaaatcctacctttgaattcaagaacatttggggaatttggaaatctctttgcccccaaacccccattctgtcctacctttaatcaggtcctgctcagcagtgagagcagatgaggtgaaaaggccaagaggtttggctcctgcccactgatagcccctctccccgcagtgtttgtgtgtcaagtggcaaagctgttcttcctggtgaccctgattatatccagtaacacatagactgtgcgcataggcctgctttgtctcctctatcctgggcttttgttttgctttttagttttgcttttagtttttctgtcccttttatttaacgcaccgactagacacacaaagcagttgaatttttatatatatatctgtatattgcacaattataaactcattttgcttgtggctccacacacacaaaaaaagacctgttaaaattatacctgttgcttaattacaatatttctgataaccatagcataggacaagggaaaataaaaaaagaaaaaaaagaaaaaaaaacgacaaatctgtctgctggtcacttcttctgtccaagcagattcgtggtcttttcctcgcttctttcaagggctttcctgtgccaggtgaaggaggctccaggcagcacccaggttttgcactcttgtttctcccgtgcttgtgaaagaggtcccaaggttctgggtgcaggagcgctcccttgacctgctgaagt

SEQ ID NO: 139579 - DNA, 1032 bp, Homo sapiens
gggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagc

SEQ ID NO: 139580 - DNA, 1052 bp, Homo sapiens
acgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcggtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggt

SEQ ID NO: 139581 - DNA, 1723 bp, Homo sapiens
cctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcaccaccactcagagtccccaaaggcccccgtgccactgctcccacccctgcccccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagtaaacttagagtttcgtggcttcagggtgggagtagttggagcattggggatgtttttcttaccgacaagcacagtcaggttgaagacctaaccagggccagaagtagctttgcacttttctaaactaggctccttcaacaaggcttgctgcagatactactgaccagacaagctgttgaccaggcacctcccctcccgcccaaacctttcccccatgtggtcgttagagacagagcgacagagcagttgagaggacactcccgttttcggtgccatcagtgccccgtctacagctcccccagctccccccacctcccccactcccaaccacgttgggacagggaggtgtgaggcaggagagacagttggattctttagagaagatggatatgaccagtggctatggcctgtgcgatcccacccgtggtggctcaagtctggccccacaccagccccaatccaaaactggcaaggacgcttcacaggacaggaaagtggcacctgtctgctccagctctggcatggctaggaggggggagtcccttgaactactgggtgtagactggcctgaaccacaggagaggatggcccagggtgaggtggcatggtccattctcaagggacg

SEQ ID NO: 139582 - DNA, 1139 bp, Homo sapiens
ccttggctcctgctcagtctctgtttctccttttagccaaactctctaagagttctctccactcatgggccctcttccttgcctgctgctccttgctcagcttgctccatgaacacttgcttttccacattccatgaaataatcttaacagtcatcagtggctgtcactccttctcagccctttccttgtgtctcttctggtacctcatactctccaggtggccatctcacctcacatcttgaaccctctgggtttgggagaattctcacctcacgagttgatgggaggcctggcgacctctgattgtagtcactgcaaatgccagatgcttatttgcctagcttccctttcggtcagggcagcagttggcaaacggtatctcaagggccaagtccggcccactgcctgttttcgtaaatgaagctttaccaggacccagttccaccccgtcctttgtgcattgtccaagactgctctcctgtacaacagcaggtgggctggttgtgacagatactgtctggcccacaaggtggaaaatactatctggccccttacagaaagaaattacctgagttctacacgagggtgtaggtatgtaccctggcctctgccagtcagactcacatgctaggaggagcagggccaggcaggagagccgtgtctcctggcattggggctgcaggaaagacgagctcctaggccacagtgccagtggccagtgctgctgccttgcagggtcgcacaggcagtgctggctgtttggactggcttggcagaaggatttgaagtattgttcctagccaactggactcaaacctgttcctccaaccctctagggattctcttatcacccagtagccttttccccctagttttaaaaattgcagtaaaatacacaaaagataaaatgtactgccttaaccatttttaagtgtacaattctgtggtattgagcacatttatattgtgcaaccatcaccacatgcatcttcaatagcttttcatcagtccttgtctgcataaatcagctagagttggtttctattgattgccaccaataatcttgacagatatgtctgatcttccttctctgcactgactcctctttctctgtctcctctgctgattctttctcctc

SEQ ID NO: 139583 - DNA, 1114 bp, Homo sapiens
atttggggagcacagacaagtcaaggttgatgtgcatccgctgaacatgatcttaagttgttgaagtaggtattattaatgaacgaacgtctattttagctccaagagcccctggtcttccagaagagactcccaatgatcttccagaagcagctgggcttcttttggtcctcccccacccaggtgcagtcccgttctccctgcctgggtgagtttgattcctctgccgtggaataggctaggctgctacctcttgagcctcttccaccaggccatccattaggtggcgacagagagcactaaaaggaactactatggaaataaaacttgttttgcttcttggggggaaaaaaaaagaaaaaggcttgtggggcgtgtgtgcattttagtcagattttactgtgcaaaacatttgagagatttctgccctctttctcccttccattcttctcaacccactgggcgccctaccacccctgtctccttcaagataaggtagatcagaagaccaaatagacaaatgccatgtccactgttttctgtcacagttgatagccataccagtcacccaagctggaaacccaacaggcccctgcccttcactgcccacatccaagggagccaccaagtcccacaaattgttcctttaactgtttgtccctcttttgtcttctgtcatcccttctaccgctgtcctggttcaatccctcatcttgctctgggactcccatgataacttatgatctttcctccacctctctatcttccacacaatccctatcatcaatctcattcccctgctttaaacccaagagtggcaccctgtgtttgagtgacatcagggcccctcatgtggctcctgcttctctttgtggccccttctgttgctgctgcttttcttatggacatagccctcagcagtccaggactgcttgtagttcctcccaggtaccatgtttcttgcactcctggcctttgtcattggctcccctgcccaagtccccttctcttctcctttccttcccctgtggccttgccttgtcgtgcttatccttgaagaccctgtcaggtatctcttccccaaagagccctgcctaaccaccgcccccctccc

SEQ ID NO: 139584 - DNA, 1029 bp, Homo sapiens
gtaaacagcaactccaactcctgctcctcaggccagaaacctggcgctggttacctcatttgttcacaaatactgttactccacctgcaagatggatacaaaatctcatgagttcccctgcctccatggcccccaccctggtccaggtgtccagcttccctgcctctgcccttgccccctggttctttgtttagtcctgcaatattgtgctcttctgttcagaaccctccagtgggtccctgcttgctcagagtcacagcccaacaggatcacctctcttgccactctcccaccactcatgcactgcggcctcactggcctcctggctcctccctggaccctccaagtatgcccctgcctcaaggccttgacctctcctctgccctctgtcccaggtatcacacatgtctgctcaagtgtcaccttcccaatgtggccttccccgagcacacccatgtctgtaagtcaggcagcctgcctctgccccaccagttccccctgcctagcataggacttgtcaccatctgccacaagctgtgttactgcttggttttgtttgtgctctcccactcccttcccctccctccctctccccacccctatagaatctgagtcccatgaggacagagatttttttttttgcctcttcctcaatatatccccagtgcctagaatcatgcatattttaatttattgagtgaattaacaaataaattctgcagtgggacattgctctaaggttttgtcttataagagggacagaagaacatgcagcctgctctgctgttggctccttagcttctccatggctaacaggaacaatattgtttatgagataatcaaagccatagtcatgagttagaaggtacatataaaggcaaatatgtggagattgagttactttggcgggggcggaggggtgtgtagttatctgaaaacatggaacaaatcaatgagagtctaaatagcacccacatatttgcccctcttttaaaacatacctcctttatgagtgtagaatttaacagc

SEQ ID NO: 139585 - DNA, 1076 bp, Homo sapiens
cctataactcggtaataaaaagacaacctgatttttaaagggtgaaaatattttaatggatacttttttttttttttttgagacagagtctcactgtgtcacctaggctggagtgcagtggtgccatcatacatagctcactgcagactcgaactcctgggctcaagtggtcttcctgcctcagcctcctgcgtagctaggactacaagcacgtgccactatgcctggctaatttttaaattttttgtagacatgggctggtgtgtgtctgtgttgtctaggctggtcttgaactcctgggctcaagtgatcctcccacctctgccccccaaagtgctgggccaccacgcctggtgtggtgtcaccagagatgagccaccatgccctgcctgatacttttcttttatcatctgtttatttcttgtttatgggtgtttctgttctgattttatgactattctgtattctaagatttctctgagaatattatttgtttcctctaaggacagacttggtctctcttccatggggctggttcttgagccgccagggatggggggaggacctgggtagctgctgcgctgccccttctctgctgtggtggagtggcccgttgcctgcggggtctgtctctgaagggtggtttggagaagttctgtggaggcgaggcaggggtcagctcttgccccatggaccctcagagactgggaaaaggtaggcatcacctgggctgctgccagccacatcaagagcctttggggtgggtggggtgggggccggggaagggaaggttctagctgttgatttagaaaagacccattgatttcttgcctgagggaagaagtggcaccttgccactccaagtttgctctgctcaccagccccaacagcatcagcctcacctgggagcttattgaaggtgccctgccccaaagcttgtgggtcgggatctggcagtcagcagcccccaggtgttgcacacatgacagcactgcttgcccctcctctcgtctggtctggtctggtctggtctggtctggtctgagagcttctttggggctctgacaggtatacag

SEQ ID NO: 139586 - DNA, 1438 bp, Homo sapiens
agattacaaccatgagccatggagcccgacaagagtagccttttatttgcagaccattagagaaaaagttgcgtgtaagtagataagcatacgaatttatcactgcaatactgtttgtagagatcacagagctgttaggctaggaagaagtttttagcagttagcactagaaagcaaaactttggaaacttccatttcatcaaaagtgacctcatctgagtagggcatgtgagggaaggacctttttactcgacaaggggaacttgccagttcttgtttgtgaaccttgaagaaagtggagcatttttattttgggaccattctaggttgtggtagttccttggtactcggggttggagaatctccctctgctgctggaccttctgcctcctcatgctgtaatatgcataagaggtgtcctagaagtattcaggaacaggctgtggttgctttgttgttctgtgactgttgaactctttatatagcagtacttttttaagctgtactaattgagcatttattatgtgtcagttactgtgctagctgctggaaactatcctaccctcagcagtcttctggtctaatgggaggtacagacaggcaaatgggctatgactttacaagaggctaacttctgtgatggagagaagttccagccactaagggagcacataaaaatcagaggagatcctaccaagaattgggaggtaggtcagggaggagacttctttgaaaaatggcatctaagacctgaacagcaaggaaacattagctaggtcaaggacaaagcatcagtggggagagatgcatgagtcttttggaaggaccagcatgtgtagaggctctgacaggagagaatctctcaggcccattcagagagtccactgtgtgaagacgaggcatgaacaaccagccaggacatgtggagaggagcatttttctttttttcttttttctttcttttttttttttttttttttttgagacgtctttctctgtcacccaggctggagtgcaatggcatgatctcggctcactgcaacccccacttccagggttcaagcaattcttctgccttagcctcccaagcagctaggattacaggcacccgccaccatgcccggttaatttttgtatttttagtagagacggagtttcaccatgttggcctcaaactcctgaccttaggtgatccacccgtctcggcctcccagagtgctgggattacaggtgagagcccccacgcccggccaggctcggctttctttccaggccccgtcacactcttagatgttccctgggccccagaaggcagcgtgaggtgctctgcccatctatgctgtccttttccaccccaccctatccactgggcccctggggctcccactccactccaggtctcttcatggacccttctttcccttcacttctgtcccag

SEQ ID NO: 139587 - DNA, 2718 bp, Homo sapiens
ggccagcatagtatcagaaattagctaattcatatggggcagtttaggctttaactaggaaatgatggttatcttaatgacaaaaaaggtactgacaaaagtccttttttgaacatgtgttcaaaagaaaaagagaaactatcaaactaataactgagtttgttgaacatcgagattgactgatctgagaggcttaaaactgattgccctgaaatagacttgcatgttttggatgatggctttgggtctcccagagcacttggtttcccttggtgctgattttttctctcaggattaaagcccctttatgtgatgttgttacagcagcttattgcaacttcattcagctgcttgaaaaagaagggagactgcctctaggttccatgtgttctttcagggatggtattttgatgttgcgtattctcttgaacatgtattcttccctgagaatttctgtgtgccgtggtagaagaaatacttgccagaaatcgccactcatggtatgcttttgtagtgtcgaagtgtcccctagaggtgacaaggcttgtgatagtgttgattctaacaagcatgaatctttcctttattttagcactgtgtgttacgtgccagtaatttgcagcttatcctttgtttctagctaggtaagctgggaaatagcctagtactttgtctatgtgtttatcttcaaaatgtcccaaatagccctgggaaaaaggtcgtgcagctcaatgggggctttcaacttacaattttctttgttttaggctccataaaaatacagactcaccagttcctgctttgatgtgacatgtgactccccagaatacaccttgcttctgtagaccagctccaacaggattccatggtagctgggatgttagggctcaggtaagtaaccttcctttttttttttttagtatatgtcctggtttggccatctgttttttttttttttaaaaaaaaaaaaaaaaggaaaagaggaaaaaaatatactactcttggacagtataaaagtaccccaaagactaaagacataactgtgccaaactgtgccatataataaaaaaaagtcacttccctgagccctgaaaggtcagtgtgtgtagggttacttggtcgccacagcgtgatctgggggcgggcgtcagattagagccggaactggtgatctgcaacttcagttcaccttgaagcaggtcagctgagctgagagcgcttgcactgagcccttttgcgctgctgctgttgccttagcggtcttcagcatgtgtttgctttggtttggggtaaatggcttagtggtcaacattagtgagcagtggtaatgcattttcagatatgggaactggtatgtggttggttccctagaaggacaccctcctgaaagctgtctcagaacaccgggggccatggctaatgtcatgtgcttgctacactcctcccatggtaactaaagagagtacccagatatacatctggttcttgggactctagaggaggatgagtactttgtaaaaacctgggggccccagtcattctaggtctgacactcaggtgctgtatcagctgcagtttgaactacttggcaccattgtgtggactttagttttgtaaaaatgaatggttccttaatttctcaaccttcaggctcaacatctcaagctgtttgttgttgttgttgttgttgttgttttgttttgtctttttgattagtggtcactccgcatttgatgttttgacatgtggatttcagaacttctgtgtggtaaagcagaatgttccaattgaattttcccattttttttcccctaagcaaaaatgtgagttttcacttatgcggccattgtgattccgactgagaccctaagtcgttctttgttgtctctctagtggtttctgacacctcagtgtgaagctgttgtagacatccataagaaatagcctgcttagggattatgtgagggcaaggtttggctgaaggagaatagaaggtgtggaaggaagcggaagaccagaagagcatcacactgcctcaagtcccaaatttgattctgctcctgatcctgtgactcaaattgtcattctcttttactgctgtggggtgtgctctgggcccagctgacaggacattctttgtactccacgtatttatgctggtgggagttgtatggctagtgctttgtgctttgtctcagaaattgtgtggactaaatgtaatatgggcagtgaatgggtttcttctggaagatgttaggcctggagggtggtttgggtttttacgagtctttttctcagattacagattacgaatggatgttataaaacaggcagtgttgacaccatacagtttctcctaagaaatgtacagagagttcaacctgaggaagctaattgaaaataaacttttaaaaagaaatgtagaaagaggaaatttaaaaagtatcttatgaatgggaaagatgtagccatttgagcttcaaagaacttttgagggaattctcaaaggacagtacccgtctttagtagataaatgcttgatatctatttttcttcttttactttttaaagaattactaaaataatacatggatttatagaaaaatcaaaccacttaaaaattgatcaggtggctgggcaaggtggctcatgcctgtaatcacagcgctttgggaggcctaggcgggtggatcacctgaagtcaggagttcgagacca

SEQ ID NO: 139588 - DNA, 1737 bp, Homo sapiens
tgtttcacccgattgataggagagtgtcatgcagtcagccgaactccgacttctgtgctgtttaaatccttaggtaggtctggggcaaggcacaaaccactgtgtattcaaagggttatggtgcttgcattctgtgtgtatatgtttgtaatttccaaccagagtcgtttcccgtgcctgccctgcctctgtgcaatctagtctagtagggtagggaggcaagctgtggagtttgaaaaaaaaaaaaaaagctagatgagtttaataggctgttaccccctccagaacattcctcccatgtggagatgaaacgagaagttcatttctttaacctaaaataaagaacaacagagataaaattgttagttccttattggagcctggtttccattgctaatgtacctgcttgggactctgcatgataaatgacgtgtcctggaacctgaaatcttttataaaggttaatatcagcagaaatcttttaattagctaagagcagcttgttctcaagctgcccgagttatcttggaggagagaatcacaggaaatgtttgatatttctagtaaccagtgttttcagtgcgtggggtaaagcacactcctagactggccagtcccaaagagtgtggcaggacacctgcttgttttccctgccctctgctatggtgacatccttgcagaccagtcttgcgtggctggcagacgcaatctttttttcttgggtagagcattatcaccgctgcgatggaaggaccttgtcctcggtgcctccataccagccctttccagtgaaactactgctgtcccggcaagcccctgtgcgtgtgcatcattccgggtaggacaagatgtgaacaggtccctcttctttgggcttaagtagaagttgtgctcttctgcttttacctgtgtgctcttctgcttttacctgttctcttctgcctttctcttgcaagaaacctgtcgaaagcttgctttgcatgccattgcttaaatactttgatggtatgtatggtatgtgggataactgagtgggagccggaattggggggtgggcagggcatccccacccccacccccacatcaaagggggaatgaccatttcgttagagaataaagcctgagtcttataacttcttcaagcacatgtatgctgggtctcctggcgtgtgaatgtgttcccgctgtgctgtgtggctgttttgcagttactgtagacactgtagtctgggctctcattattgcctctgaagttgacaggaccaagccttagtaaggatgcacttgtcttcctagcccaagagctaggggtgttttatatatatattaactttcttttttagatttcataaactgctctcattttctcttttctttctttctttttttttttttttttttgagacagtctcactctgtcacccatgctggagtgcagtggcacgatctcagctcactgcaacctctgcctcccgggctcaagcagttctctgcctcagcctcccaagtagctgggattacaggcacctgccaccacgcctggctaatttttgtattttttttttttttttttttttttttttagtcgagacggggtttcaccatcttggccacgctggtcttgaactcctgacctcgtgatccacccgcttcagcctcccaaagtgcagggattacaggcgtgagccaccgcacccagcctctggctcttttctttttgacatgaaatcttaagtt

SEQ ID NO: 139589 - DNA, 1688 bp, Homo sapiens
gcgcgcgtgcgcacttcgcctcccgtcgggagagtgcgccacaagggctcctgagctctcacccccatctctgggctttgcctccccctccttctcgcccattccatgaatttctgccccccgctacccccccgcgagcgagtaggtccaccggctcctttccccatctagcaggaacaagtaggtggggattattatccacaaaagggactagacattgtgttctgggtcccacaactcatcataaagaggtggttatagttcccatcaggagccgtgggtaggggactgtgcgtccagcagcacccgaggctcttcggcgccagaggctctaaggtgcgagcgtgtccccagggtgctcagaggttctttggagtgctgtggcctcggaatgtgagcaccctcccatcctaccctccccttcgccggcgatcttccagttacataagtggagtgggacatagtaggtaacgggctctcatcgccctggagcgctcgggatcaccggtaccagatggggcaagttcatcgcgacgctgtggctcctgttaattgtgcctgaaaggttatcctctgttcagtttggtcatgaccgaatcacccaaactgaaactcagatgacttttatatggcagtggcaatgtttctgtggttttgcactaaagacttaaggtcattatgaagagtgtaaaaggattgctgtcgcaggggagaccgtttatgacattgctaagtatggaccccgagggggaaaaagctcattctggaattgctctgtggcggttgcttctgttgcgagtgtgttcgggtgtgggttggtcacagcagaaatgggctccaccacaaaattgatattcctgactcatggtcaggcagatgtgtgcttctggttatttttccaggaacaggaatgggctctgccgagcctttcacacgttgtgtctctgctgtgcgggatcagtaccccagactgtgagataacaggatcgaattcaggggttggttggtgatccaggaaccatacctacttggatgtgatactgagtggcctagacgttgtaggactctcataagttttagacattttgttatactgtaaaaatgaagcatatacggcctcagtagtaacattgcactaataggtaattattactctagagaattttgggttccatggctggaatgttcatcagtatctcagcaatttcagttaataaccagattaagctgacctcttgagtcttttgaaatctgctgggtccctataataagacagggtctggattttttaatcttttgggaatttccaccaaggatttagggaaataggcttttatgggcttttcaggatttctatttcaaatcccaatgaggaagtctaggaaacacttgcttttattttcttgcctgaatatgtcagaaccttaaatcacccaatcaatctagaagtactacagttgattaaagtaagtcaccacaggtcacccattcgtggcaggtcagctaggtggctgatcactggaatacagtcatatccccaggcatacacacgagcctcacttgacgatcccaaagtttgtacatctgagcttgagacgtgacaagttgaggtctctgctttgttcttcatagttggcagtttgtctcctcgggtgcccctccggttagctgtttatcatacgtctagc

SEQ ID NO: 139590 - DNA, 1932 bp, Homo sapiens
tgcggctgcacgtgtgcacacagctgctaggcccttgcctccaagctcttggtgacaacaggaggcacctggaggtgacaagcctgtgctgggtggccgaggacagggaggcaggccagtctggctctgcctgacctcctgtgctcccagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggtgagcctggggccaagctattggcatctgcccaacgcccggcaccacagccacctcttagccccacccactctgccttgcaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggtgggcaacccgggcccccggcccaccttcccaccaaaatgaggccagaaatcacaggatggccagtgtctgggagagcagggaccgcctttggggcgtggctttcacttctagagccacctccctgccacctcctggacccctcaaacaaagaccagggaggagctggaatctgctaagctggcctgggttggggaggtgctggcagctctttaggaagagagaactgtcaccccagaactggcttagggacaggagaggagagcaggacaccagcgggaggaagggggctgggacctgggactgaggacccctcttgcctcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagccgcccctgccctgtgccgtgctgcgctcacctgcctccccagccagccgctgacctctcggctttcacttgggcagagggagccatttggtggcgctgcttgtcttctttggttctgggaggggtgagggatgggggtcctgtacacaaccacccactagttctcttctccagccaagaggaataaagttttgcttccattctcctttgcgtggctgtagctttgttggggttgggggaccagtcaaggccaacctgacaggggtgccaatgagcagatcaaagcatgggctgagcacaggtcacctccctccagggctcctgcttcaccccaccctgactccagaaggcaccatctatctttgcttcctctgcctccctgagttcaagccaacgtaaggagaggaacatgtagcaacctggaatggagcccaggcagcaaggaggcaaagagctgggcaggagagcccattactgggtagggtggtgtcaggaaggctccctggtggaggtggccagataatcaacagcaggcccggccgggtgtggtggctcacgcctgtaatcccagcacttcgggaggccgaggcaggcagatcacaaggtcaggagatcaagaccatcctggctaacacggtgaaaccccgt

SEQ ID NO: 139591 - DNA, 6210 bp, Homo sapiens
agacccccatccccaccttccaggggcctctgcgtcccgggccgggggaggtgcatgagcgggtggggctggctggtagtgcagtagcgccagtgtcgactgcttgggcggccagcatggcggggcccggcccagcctcagagccccaaagtgcattctgtggcccgtctccctccttcccccttcccctatcccccagcagtgacgttattcagacattccccaacaggcatggagggtcacctgccccagccagggacacccagggatgctgatgagaggctacaggcctggcacttgggcgaggtggctaaggaaagggtgagagggtggctagagttttgcggcaggagcgagatggctttatagagcaggccgtaggatccgatgtgtgtgtgacaggcgtgtgtgcgcagggcgggggaggctggggagtactgattgcagggccttgggggctttgagggtgggagcaagactcagtaacctcagtttccctggctactgtttgcagaatggagacagggagcccggggtggggaagggggcgctgaagttgctctctggcaagcttgacggccacggggcttcagtgagagccaaattaggaggcatactttgaggatggagtggctgagacctgcggttggctgggagccgggcagggaaagtgggggcagtcgggtacctgtgaggttggggcccaagccactaactagatggcatggggtgcacatgagtgaagcctcccagggcagcgtgggcagccggcagccaggtctggagcctgggagagctgcctggccgcggcaggccagcatggagcctagtgcagcaggagccctcggccgatagtgggacttggtggcagggcccctcgagcttggccttcaagtaggtttcgtgctcctggctgcttccctggcaggaggccaggctgcagggggcactctcactgccaggcctcacagcccacagccccccaagcctccacggcggagacccagatcataacgtcactgtctctcccctttcctcgggcactctggggccctggagcctgctcagctgctctgccctcgcaacccagcagtggtggctgtagcttgggcctcctgttccctgtctccctgggtgctatccccgctctgccaagcctgctgcgctgcgctactcgggtgctaaccccgctgcctcccgcttccccgctcccactcctgtctgcaccgggctgcttttcaccgcgagccttctcagttgtcaggaaactccggtttcaccatcaggcctggggggtggggaggcaagtgtcacatccccccacgctgcagcaggactccgcctcaccgcgtccacacacagcaatgggggccggggccaggccagaagggcgcaggcagccgtgtgcccagccagatgctggcgttcagcagtgtgggccatggtgctggacgaggctgagtaggcaagggagtggctgtcaacacttaggctggagtgggcccttccttttcctcccaggcacctgggtgctactgtcgggcctctcccacatgggcacttgaggtggtcaggagaaaccttcctgccttctgagaaaccactcgccatcccagcttggaggggcagggcggggcaggaggcctggcggcctggctgtgcttggtggtggcaatgagaggcctgtgtgggcggcaggcggacgggaacaacctgaacccgagctcacacgctggcccccctttggggacccaccctgccccaccaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggtgaggaggggtggggggtaggtcagcaggggtgtctggcaggtcccggcctgttcccctggggcccctctgtgacaacagactctccagcagctctctgctttgccctgcaggctctggctggggaccagccctcggtgcagccccctctacggtctcagcagctggccccacagtacacctacgcccagggcggccagcagacttgggtacggcctggccagctagggacactggggctagccagctgggtgttctgtgagcccctagtttaccatgtgtgaggagggaccccagatcctcccactgtccctcacccatgccctgtgtctccactgcaggccccggagaggcccctggtgggtgtcaatgggctggatgtgaccagcctgaggccctttgaccttgtcatccccttcaccatcaagaagggcgagatcacaggtgagtggggacttgggaaggagctcgggagccaaggaggccagactgtgccaatgagctgccctgacctcagccccactgccccacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggtgggcctgccctgcctctgcccactccaccgccaccacctcacagagagatggggctgggggacacacgaggctgccattccacaaggcccttcttcctgcctcaggaagccccttgcagttctatgtggattacgtcaactgtggccatgtcactgcctatgggcctggcctcacccatggagtagtgaacaagcctgccaccttcaccgtcaacaccaaggatgcaggagagggtgagcaatagctctggtcttgacctgctctgtgcccgggatgccctcaccggggtaagggctggactcaggagatactcctgaatggggctccctgccctgctgccctggccatcggagctcctcagtgcaggccaactggagtgtccccagcatagttcccatgctcacccacggctctctccagggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgggtggcactgggagcagtgacagaaacgggtggcagggtgggcatggtctcccatggctggacgcacactgatggctggcctgtccccaccaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtgggtaagcggctgaagggtccagggggttcagaaaggaggcagcctgtggggagccatgccctccctgactgacagccatgccctgtgtccagggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggtaggcagtggctgcccaccagctggggcgggagcactgtgcatagcaccgaggctcaggggtatccatcccctaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggtgagtgcagcagtgcctcggcagcccccctcactacaccagggcccacaggcagtatgtgactggaggggcgtgggccgtgctttcttcctgcaggcagccccttctctgtgaaggtgacaggcgagggccgggtgaaagagagcatcacccgcaggcgtcgggctccttcagtggccaacgttggtagtcattgtgacctcagcctgaaaatccctggtaggggctgtgggaagcctggggaggggtcctggggctcaagcagccccaagaggaggggtggagcccagggctgctgctcactagcccatccccaccctgcagaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccaggtaggcctgctcacaccccgagtgctcgctctcctgcgttggccagggtggggttgggggtggaggaaagagccggcaggcatgtctaccttggctatgcctggagggggccgaggctggtgaagcagccttcagtgaggacaaactgttctcccacagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtactgggaacccggctggggttggaggaggtggggcctgagtgtgggtattggacccagggctggcacagatagccctgcctggcactcactcttcactttgaggtcacagggccacccaggctgttcgtgggaggtgggaggcccaaaggctgatgagccggtcttacactctttccctgcccaggtgactacgaagtctcagtcaagttcaacgaggaacacattcccgacagccccttcgtggtgcctgtggcttctccgtctggcgacgcccgccgcctcactgtttctagccttcaggtgaggcaccgagagaaaccgcccacctggggctcctgggcccggacagaccagagccaccgcagagaccaggccttggccctgtgttcagtgacccccctggcccagctctgggttccaggcctctgctctggccgggtgcagcccacgcttggggtcggcaggaaatatcctgcccaccacgtggagtttttctcgtgtctcaggtctaaaggctttgaacagaagcctgtgccccttgagcaccagggctgcggtttaaagagggacagcctgccaaggctgggtgctgcccacagggtggggcagccctcccttcctgccacctgggtgtgtgcgacggcagagtgtgggggcaggggcggggatgtgcgcctgtggcttgctgccccttgcaaatcagtggctctccctctttaaaccaagttggacgccagatgggtaagtgcgacccgcgggcctcttgctcctggggcctttccgtcctcccttgccctggctcaagcacccccatctaaccatgtctgctgtgcttccaggagtcagggctaaaggtcaaccagccagcctcttttgcagtcagcctgaacggggccaagggggcgatcgatgccaaggtgcacagcccctcaggagccctggaggagtgctatgtcacagaaattgaccaaggtgaggccctgtccctgcccggccgccctgccctgctggctggaagcaggctgagagtacaaaaggaaggtaccgcttctgtaagcagccaagacggggccccaactcctgggccccctaagccaggcaaccctttcccaattggtgacccaagccgctggggatgtggctcgccacccacagctattaggaaggccttctaccctgcagtaccatgccatctccacagggaaagactcaaagtccagcctcagtgctgcccggcccttcagccacgg

SEQ ID NO: 139592 - DNA, 5517 bp, Homo sapiens
gtcagactggtctcaaccgcctgaccccaggtggtccgcccaccttggccttccaaagtgctgggattacaggcatgagccaccacgtccggccgcttcatttatttttatggccgcataatactccattgtgtggccagaccacattccatttttccgttcacttgctaacagatattgaggatgagcttgcctttggtgatcatgaacagtgctgttaacagtgagtccaggtgtttgcgtggacatttgctttcatttctcttgggtagttgcctcggagtgaaccggagcatcacacagtccctctgtggtcaactgaggaactgccagactcttcccaaggcagctggaccattttgtgtgcctgccagtgtagctgagggagcttctgagtctcctccaggctgctcatgcccttgcccttgcccctgtgccctgcaggtgaatgtgggagctggcagccaccccaacaaggtcaaagtatacggccccggagtagccaagacagggctcaaggcccacgagcccacctacttcactgtggactgcgccgaggctggccagggtaaggcctggctgtgggtgggagggcaggtggctggggtgtccctgcgaggtctcagcctccgctcctctccccgccgcaggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggtgggtgctgcgctcctggccgctaagatgtcattgcggatgacgtctgccctcctctaaggccttctcctcccactgcctgcaggccacgcccaccagccccatccgagtcaaggtggagccctctcatgacgccagtaaggtgaaggccgagggccctggcctcagtcgcactggtgaggacaggtaccccatggcaggttgcggggcatcaagggtaggagggcttggggcagggtgcccctacatggtccctgtgtgttcctcaggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcaggtagccacaccctccactacagtcaccgagtccccagcctcctcatgcagcagcctaggggacagctccgagggactttctgcccactctcattccttacctgggagaggacaggcatggaggtccaggagggggttggggagcaattctggtgtctctaaatacccccttcccttctgcacccttcccagggtccagtaggcgtcaatgtcacttatggaggggatcccatccctaagagccctttctcagtggcagtatctccaagcctggacctcagcaagatcaaggtgtctggcctgggagagagtaagtagttggggcccttgtcgcaaaggcctttgtcacatccagggattggctgagctgggtgtcatgtctctctccttcctttcatcgtttccacagaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtaattggggtatgggaggccctaagggtagaacccactgtgctctctgagggccccaaaggtaccccatcttctccagacctgccctaaatccttttttttttttttttttcctgagacagactgtcaaccttgaccctgtttaagtgagagtaaaggggaggagggaaatagaaacccacaaaaagtcatcagggttgaagaatttcttttttttttttttctttctttttttttttttttttttttttttttttttttgagaaagagtctcactctgtcgcccaggctggagtgcagtggcgcgatattggctcacggcaccctccgcctcctggcttcaagcaatactcctgcctcagcctcccaagtagctgggattacaggtgcccgccaccatgcccagctaattttggtaattttagtagagacgagatttcaccatgttggccaggctgttctcaaactcctgacctcaggtgatccacccaccttggcctcccaaagggctgagattacaggcgtgagtgaccgcgccctgccctcctttttgtccttatgactgatggatggcccatctggcaggcagcctgggcccgcccgtgtccctgtttggtgagggcaggaagccagggcaaggggaggcaggtggaaagtcaagcaggaggtctgggatcggggcatagtgtggccttggctcctgaccccttcttccctcaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgagttgccctgccgtggggtatgtgacgggggacagggaccagaacccccgagccccaagcctcctctctgtgcctttgcaggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggtgcgtgctggggactcccacaggctggcagacggggtgggtggggtggcccgggctcctcctgacctggcctgcactcctccaggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggtaagggagcccccaggagcccgtgtggctggtgggcctgggaaccccaggaatgaccggctgtctgtttggaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggtgaggaggtggcggccagggcagggctgggactgtctgctcgtccccaccctgtctcatacagccgccatccctttgccccaaccctcaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggtgagtgtttgcatgcctggagccaggggtcaggagggcagtgtcctgtttgagggccgggaaaggaaactggaggcccaaagtgaggaccagagtgcagaggtggtgcaagtgtgtaggtgtttttggaagagcctcaggtgacagtgcagccaggtgggggacttggaggaggtagagcagatgggactggtcactgagcagatgtggcaggaaggcaggcaggcaagggtcccagctggcacccagatgggtgtctttcgtgccagagggggtcaaggccattcccagggtcgggtggatgaggataaagcgaggtctaggcctggggctgggtcctggccgtccagtgtggtggggtaggaatggaggcccaggagactagctgatgctctgtccctggggctggggccaggcctggtggagccagtggacgtggtagacaacgctgatggcacccagaccgtcaattatgtgcccagccgagaagggccctacagcatctcagtactgtatggagatgaagaggtaccccggaggtaagaggcagggcctgctgcctgtggggagtggcccaggctggatgctgagaacctgtctgactgctcacaacaccaatccctcacagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggtgagctccgggcacaggcaggggaggcaggggggcctgggcggctggagtgtgggctgcgggtggctggtgtctgatctccctgcggagctgcaccaaggagggcagggaaggacagggcccctgtctttggtttgctaaggttgtgactaccttaggatggtggtgacaggcacaggcttccccagacgtgcacttgctgctaactttgagcacgtcaccaaagccttctgtgcctcagtttccccacctgtaatattctcatggggcaggtataggatagaagcttgagatcaccccggtgagctcctcctagtgctggccaggccctggggctgaggatgggtgccaagctggctggccgcgcctgttgtcatgtgggaagtgtgggatgttttagtctccattctggactctgccaggtgcaggcagcccttttgggccatagcagttaagatgcctgaggcccagagactgtccctgtagc

SEQ ID NO: 139593 - DNA, 3506 bp, Homo sapiens
ggtccccaggggtcttgggttacatggcggctaggtgatcaagccacccaagagtcagacaagagtgggtttttgggactagtgaaaacgacaagagaatgctaataggttcctccagtcacagaagcctgctgcgtggggtcctcggggaggtagcatccagcggtctttattataaatggagatgaaccaggtctcagtaacagggacctaaaacccagtcaaggctcacacaggaacaagggcccagtgcggtgagaatgaatgttccagaaaacaggctgggcctgtcccagcagcgagagcacagctgggtcccgaggccaggctctgtgccacagctcacactgaatgaacttgcccagtttggaatgtgcctgacttaggggccagcagggagggctgaagggtggaggggtgaggctgtggccttaacagctggcccgtggttggctcgccttcccctgccaggcatcgagcccacaggcaacatggtgaagaagcgggcagagttcactgtggagaccagaagtgctggccagggagaggtgctggtgtacgtggaggacccggccggacaccaggaggaggtagggccagctgctggcagcagaggccccgcagcgctccctttcagtggggctgctcttagcaaaggctcacaggctccttcccactgcaggcaaaagtgaccgccaataacgacaagaaccgcaccttctccgtctggtacgtccccgaggtgacggggactcataaggtgagcccttggccaggggggaggcttgtgacctcaggcagtggctggaggcccccagccctaccctcacggcccacccttctggggacaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggtgaggggaggctgccaaggcccagctggtctgtggggagagccgcactggggcctgggagctgagcaggtgcctcgtggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaaggtaggcccggccctgactgccctctgctgtggcactgcagtctgggcctcccacaggagggggaccccctgggccagtcccgctgcagcccgccccggggcccctactctttgagcttctactgtctgggcacatgctgtttttcctcccctgctggggcccttcctcctctcctctcctcgcccctctccatctctctcctcacgctttcaccttcggaagagctcgctccagctgtctagaaacctgctgctctctgctctgcccacagggtcaacggtacttggatctgtcttcttcttggaagggggaggctggggggctctgggctggtgtggagcaggtgggaggaggcctgccatgtcctggcccaggccacagttcctggggtcacagtcccttccagttctgtcttgcatgtccccctccagccaagctctgagggacccaccaatcctgacagcccggccctgtgggaggcaagggaggggtcgcccagccgagctgctggtgctcagctggcccctctgcctgcagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccagtaagttggcctggagccaggccaggatgggtggcggcagcccccgggttcactgctgggcaggcctgaggccctccttgtcttggcagagggagaggagcgcgtgaagcagaaggacctgggggatggcgtgtatggcttcgagtattaccccatggtccctggaacctatatcgtcaccatcacgtggggtggtcagaacatcgggcgcaggtgaggcccccaggcatccctctcccagctctgcacactctgcctcttctcttccttctgcctccccacctgatgatgaggggccacatgggctcttcctgcctggccgccacagtggggcccacgctggctcatgtggtgatcctcggtgttccctgtgtggctctcgcatttgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggtaagttggaggctgcagcatgggcacctggggacagacgatggcaaggacggcccaccctgaggctccagggcactgaggggactggtggctgttgtcaggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtaaagagcaggctgtgatggcctaagtctcgccctgctgctcctgcttggggtctggtggggatggcactctgtgtccctggccaccctgcctgggttgtagctctggcagcctggacctggccccctgacagctgggtggtctcccgctaggtgaaggcacgtgggcctggattggagaagacaggtgtggccgtcaacaagccagcagagttcacagtggatgccaagcacggtggcaaggccccacttcgggtccaagtccaggtagagcacccacgggtgttgggggcagggcaggtgtgggcacccaggcctgggcactgaccagcaggccacctgctcctatctgcctgacaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgagccaacctccaccggcctttagtccatctcgatagcattcacgtagcacacgattcgtccatttcaagtggttgtggcacaccatcctgactcccctgtcccacagctcctggtgaccactaacctgctttctgctgtggctttgcctatcctggacatgttctatagatggaactgtgtgccatgtggccttttgtgtctg

SEQ ID NO: 139594 - DNA, 1158 bp, Homo sapiens
ccccactccaggtcatgggccctggattctgggccagctggagtcagcctcctcctcctggttccccataggcccctgaggtgtgtggcggacccctgctctggcagctgtggacactgtccagctgttctccagagctgcccatctgcaggctgggtctgccctctgcccttcctctgggcccagggcttctggcagtaatcataccctgctggcatcgtgtgtgtgtgtctgtgtgtatctgccctcaccccaaagtctccttcacctctgaacaccccctgggaccctgggcagagagggcctcatccacatcctaccactggccaagagggggtgtctacctcctccttggcccctgctaccccgtgctgccagaccctgaccccaaagcctgggatcggcccctcccgcacagccgtgtgcccagcgtggccactcttctactcacagacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggtgagggggcgcagaggcaggagagactgggctggggtcacccatgggtggcccttgagggggttctgcggcccccagactcacagcctcccttgcgccacaggcctgtgtcctgactgggactcttgggacgccagcaagcccgttaccaatgcgcgagaggccatgcagcaggcggatgactggctgggcatcccccaggtacacccgcccggcctggctacagctgtaggggaccggatcggcagttgggagagactcggaggcccgatggctcctgttttctgcctgtgacaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggtgagggagcc

SEQ ID NO: 139595 - DNA, 2021 bp, Homo sapiens
aagagagccaccccaccccccgcaggggccctggggaaggaaagtcccttgtaaggcgcgccggctgcaggccaagcagtcccgcgccagacactgctcagcctttcctcgctctagggcgcgtttcctgcagcgccaacgcgaggctgcggggctgggagcatccttgcccaccccactgcccagcgacccaccctggagcccgggtttcgcgtctgatcagccgaacccgggggcctagtgggggcattccaacgggcggggcggggtggggcaggcgcgccctcgaagccccaccccacggcccctccccgcaggaggcccgccctctggccccgccctcctcccgcatttaaagggctcgctctctccgcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcggtgagggacgccccgaagcgccgggcgggcgggggcggggactccgtgcgtccttccatctccccgggcggacccctccaaaccacccccttccgggccgcagcgcaactcccgaggcctccggctgctctgctccacgcgggcctgcagaacaaaggcgcgcgggctggctggctggccggccgggcgtgcgaaccgctacgcgcccccgcccgctgcgccccggctggccggcgcccaggctgaactcacatcctccgcaggccgcgcctccgcggctgtgctcgcggtgggagtgggcctggggggtcgggcactgggcaggctcctggccctgcgccccgtccccgaggaggaggaggcccgggctctccccccacagctgtttagagagggccctctggccttcagaggcccgttggttctgaagtgtgggttggagctcgtgcgtcccattgtctggggctctgggctctttgtgtccctggaggatgggtcgcccatcggagatggctccaaccaccagtttagatctacccccccacacacacacaggcaacctgggggccagaaagaagcatagttagcaaaactgcacccggggtgagttgggcgtggttgactgagagacctggcttgtagactacttggacgccaacttttctcttcatcttgggccaaactcttgcttccatgtaggccttgcttttctgcgtgtagcacgcaggagttggttggtagatgctccagcgtgcattgtgccagcccagtgtctgtgtcactggactggagaggctggcattgaccaggcctgctgcagcagcccaattcgttctcaagataggggctgcatgagagggcaggccccagaatgggtgactcgggggtgatgtggaacagggagaggagagggatgatgagtcttctcttcttcagaattgagaggccttccagttaccctgcagccctggaatggcccttgctgaacccaagaaagtgagggaccaagacttgggttcccccagccactcagagggcagatcccaagaaccaaagttctttctttggaatgccagttgaggcgaggggcaggcccacccccacaagtcccagcctcagtctagccaagctgagtcatctcagtcctggatggtag

SEQ ID NO: 139596 - DNA, 2711 bp, Homo sapiens
gcgcgggcccctccccctccatcgctagccaatccccgttttgtgacgtatgggctcgcggccccgctcgctcccaccgcgagaccttttgctccgcgcccgcgcgggccccgccccctccatcactagccaatccccgtgcttgtgacatatgggcttgcggccccgcccgctcccatcgcgagaccggttcccaccgccctgactcccgggcgggccccgccctctccgccgctagccaatcctcgcgttgatgacgtttgggctcgcggccccagcctcccagctctcagggcacggccggtctgtgccggctgctcccgcggttaggtcccgccccgcgcagcgcgcgcagcctgcggagccagcggccgtgacgcgacaacgattcggctgtgacgcgacaacgattcggctgtgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggtacaacatcccgcacgggcctgtagtaggtacgcggcggcgggcgggaccccttccgggccccctcctcgtgctccgcctcgcgacctccccgctgccctccccgcgcgccttccccggcccgcggccctgaccgccccgtgtccggccaggatcaactcgtaggctttacgagaagaagatcttcgagtacgagacccagaggcggcggctctcgccccccagctcgtccgccgcctcctcttatagcttctctggtgagagcctcgcctgtggggacagcctgggacgcggggaggatggggtcgcgagggtgtggcaggggggccggtcgagagcggcactggagaaaggggagggaagtctgggggggcaaacagttctgtctcctcctttcaatccagacttgaattcgactagaggggatgcagatatgtatgatcttcccaagaaagaggacgctttactctaccagagcaagggtaaggcaggggttgggtgggcacgctggcaccttcacccgacttcgtcagggaccccgctcacagggaggacctgagacctcagtcccaaccactccagcagccttaggagggagaaactgttacaggtcccgaaatgggattcagattagggccatcaggccaggcggggcacaccgatgccccctctgctaccgctgccccccttcccaaggctacaatgacgactactatgaagagagctacttcaccaccaggacttatggggagcccgagtctgccggcccgtccagggctgtccgccagtcagtgacttcattcccagatgctgacgctttccatcaccaggtgagctggctggcaggcgtcctgtacttgggtacaacctaggggatcgcggctgtgtttggataaatccaggggggcactgggtacaaatggtggctcttgggcctccggggagactctgtgtgactagagcaccctggtctgggatctaggctcagactcttcctgagagtcctgggggcaaaaggggatgctggggcatgagcacaagtggcaaggccccatggataaagggctgaacacccagagccattcaggagggtgtgggttcctggcctctaaccaaaggtcagaggggactggctggggaagtttggactgagggacatgacagggccatggtggccctgccagccagtcccctcgccctgactctcttctgcaggtgcatgatgacgatcttttgtcttcttctgaagaggagtgcaaggataggtgcgtagtgggggagcccagggacgggctggttctgggtccaggctcctggcccacttgctcccctcttttgcctcagggaacgccccatgtacggccgggacagtgcctaccagagcatcacgcactaccgccctgtttcagcctccaggagctccctggacctgtcctattatcctacttcctcctccacctcttttatgtcctcctcatcatcttcctcttcatggctcacccgccgtgccatccggcctgaaaaccgtgctcctggggctgggctgggccaggatcgccaggtcccgctctggggccagctgctgcttttcctggtctttgtgatcgtcctcttcttcatttaccacttcatgcaggctgaagaaggcaaccccttctagagggagccatgagggtctgggcttcagagctaggtctttggggaagtcctggctgactgccttagcagtgggggtgggggtgggggcaggggcaggggctttatgtgtttttgcttggggggcgctgggcctagcccagagtagtgcttgctccccctgccttgtcccaccagggaggcagcagactcaggccctccatggtcctctttgtcattttgttgacatgcattcctccttttgtcatcttgttggggggaggggattaaccaaaggccaccctgactttgtttttgtggacacacaataaaagccccgtttatttgtaatgcgttggctcttcctggaggagagggttgggctcccatggcaagggcctctgcgtcttggggctccaggattgcaatccggctttgttgggtccgcatttttgctttagtctggggataggaatcaaa

SEQ ID NO: 139597 - DNA, 2906 bp, Homo sapiens
cagggacactctcgcggtcgccgggaggcccacctagggtactttccttttttccactctcagaaatatacgtctgtcacagttaacggcaaagcctagggcaagagttctacgcccaagatggccagccggaagcgggcttctcgcgaccatgtggcgaagccccattcgtcagctggccgcccgcggccctggtacccggtcacctctctgatctgcgcatgtgctgggctacgcccgggcgcaagcgccaagagcggctgcgtctatggtcatgacgtctgacagagcgtccacccgtcttcgacaggactctatggttcttacgcgcgcagacagaccgcctatataagccatgcgcaggcggaggagcgcctctttcccttcggtgtggtgagtaagcgcagttgtcgtctcttgcggtgccgttgctggttctcacaccttttaggtctgttctcgtcttccgttccgactctctctttttcgttgcagccactgaagatcctggtgtcgccatgggccgccgccccgcccgttggtgagtcttgaatccgtgtactttcactgctgggaaacgggcggggaaagaagtgcctatggccgctgaaaacaattgtggggtggagcctcccccgtgcggcggccctgtcttgggaactgaccctatgttttacacctcccggctattttttagtctgcaatattactgtctgttccttcgttcccgtgtcggtgtggaagcgacggttccctcgtatctctgcctgtgtcctgcaagctcaccgcattttcgggcgctagatacgctcttggggcctttgtgtgcgttctctgtcttatttccgggcgacgtgccgcgtgcgttgtcggacgtgaagggcagtccgggaaaaacgggtgcggccgcctcctgtgtcctacagggggcgccagacgcatttccactcggcttggaggtggatttagtgccacgtgcccgaaagtcttaaattgggtgacctgagctgtgcaatgataatgcggcgattttgtagtacgcagtgtcttgaagagagaatttttaactaggaaagtttgttgcaaagtgtttataggaagcgtaagacaaagtaacggaagatggtgtctgttgtttctagtcttgggtgttgtctgtgttgcagcagccaactgttgctttgtagtttatttccccgaatggaaacggtttagaagtggacgtgcattccccacccttttcccgtccctcgtttgggttgttccttgaggggcaaagtgcctgttgggctttctgtgaacctcacctaacctgtgttttttcactcccctgcagttaccggtattgtaagaacaagccgtacccaaagtctcgcttctgccgaggtgtccctggtaagtagtggaagagcccctgcactggttggctctgcggactccgcgtccgtctgtgacaccccctgcacacttacccaatccttttagatgccaagattcgcatttttgacctggggcggaaaaaggcaaaagtggatgagtttccgctttgtggccacatggtgtcagatgaatatgagcagctgtcctctgaaggtaaggcaggattctttgttcgtcaccccccagtccttcctccgtgctccctcaaccccacccacatacactgcactggaattgggagttgatgaaacatgagccttacaaaactcagccaacacagttcccctgagctggagatagtcgtggtgaatgtttctctattatcttctctcactttgctgcttttcttctccctacctagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggtgagcttggtctgggccttttaaggcagttggagtctctacattattaggcttgcattattttatcagagcatagaggtggccccagtgactcagccactatggctactagaaaagccaggctggcaagtgactttcagtggtcactcaggaccccttcctgcagatacaaacaaagcatgagtaagtcttagcaagctcttccccacaggttaggggaaacactggtgatgggagtagctcttcttgcttttagctgaatgacaaccatcttgccagcaggtagctgaagctggcagaggagcccagtggcgccttttcagtggttcttgggatgctccgcagccaattaagccgactgagttcctttcctcatggggacccagtgtgcgatggctgcacacagcagcttccttggtagtgtacgcagcctgttggttgtatgggttgctctaagggaccttggagacaggcctttcaggtggatgttcatgtttctgaccttgcactaccccaatgtaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaaggtatgtagtgctgcagcccccttctcccacctttgccccaggcctcctgactcagttctttccattgctccttagatccacatctcaaagaagtggggcttcaccaagttcaatgctgatgaatttgaagacatggtggctgaaaagcggctcatcccagatggctgtggggtcaagtacatccccaatcgtggccctctggacaagtggcgggccctgcactcatgagggcttccaatgtgctgcccccctcttaatactcaccaataaattctacttcc

SEQ ID NO: 139598 - DNA, 1821 bp, Homo sapiens
tcttaccaatccacaataaacatggcccattggcatatctgctgcacaagtgtcctatctcaccaatctgggtttttgttctcagtaactttccttcttgtcatacaacatcttcattcctctttctgaaccctcccttcccctaccccaacccagagcccactttgtctccactcctgatactacactacctggcaggtggcatgagtgcagggcccctggcttcctctcctaatctaggcacaagcccaaccaaagaacaagagccaaatcaaacaaggcaggcaggggtggactacagtcacagggcaactatagttgaagccccccagccccagggctggatggacgggggaggctggggtttaagtcccaaaaggcagcaggccctgggggggtagggggacgctcaggcagcagggcacagctgaggggacaggagtgatagcagcaacagaacagtgaggctgagaggctggacgctgtgcgcctggctcagcttcagctccacctccacggggtagtggtcactgatgttgagggcctgggaatgggtggtggggcagtgtcagtgcccggggccgaggggcttccctgtgaccctgctgctgccctccctcctcatgccagccccatcccttcacctcctcctcggtgagctggaagctcgtggggaagtcaaaggcagccgcagtgtgcagcagactccggcagcgctccccgtgcagcacgacgcggtcataggtgcagtgggtgctggcccgcactgtggtgtcctccccatcggcaatcacccagtggaagcctggctcagtccgcagctccagcttgtccaggcgctttttggtcagtgaagcgcagtcagcattgaagtccccaagcaggatcacgtcctagagacacagcagccatcaggctggccgctgggccaccctatccttgtccctcctgtacaaactgcccaggcctaccttgctctgccagtgctgggagacctccagaaacacatcgtagagggcgttcagctccttctctacggccttaggagtggtgtgcagcgggaccaacaccaggctgggaaggactgcaaggcccagggaccgagggctgccatccactcctggaccttctccccctagcccgtctgggtgaggaagcccccagtggagccagccagaactccccttctgctcccacataccaagcccacccttcccttcctaccattgctgggcaaagagaactgggccacaaatggctcccgggcaaagacgtcatcctcatcgttgtacacgtaggaactcaggacctgtgttttgtgtgacctgggaggacaaagggatgggcagcagtggccccacgtctttgattttggcttgcaagtgccaaacggcgctcagggaggggccctccactaacagcggcaatgtgggcacagccctcccaacctgtctctagaactttcaaaaatcaggcataattcatatgccataaaattcacctgcttcaagtatacaacacggttcttttgtacattcataaggctgtgcaactattgctacaatcaattttaaaacattggtatccattactcctaataaaaacataacatccattaccagttactctccattctcccctccccccagcccctgcaaccattaatctgttctctatcttgtacatttgcctattctggatatttcatatgaatgaaatcagctcatcaatgttttctgcgttcgtccatatgctgtggcacgtctgtgcttcattcctctttctggctgaataatattccacggactgggtatagtacat

SEQ ID NO: 139599 - DNA, 2082 bp, Homo sapiens
atggcgtctaccagaaggggatggacttcattttggagaagctcaaccatggggactgggtgcatatcttcccagaaggtcagcagggctgactgggtcgagcccccccagtatgagcgggatgggctcccaagcctcgcctctgtgctctctcaccagggaaagtgaacatgagttccgaattcctgcgtttcaagtggggtaagggctgctggtctctggccacagccatcctcccggcccagagatggccctgtgggcccctggctcccgccccctcgggctggcttgtatgggggtagatgggcgtgtttgtagcgccaggaaggggacaggtgctgagactaggcctgcctctcgcaggggcttgcccaagggagctgaattgaactggaggatgtcgggggtggcagtggccagaggctggcacagaagcttggctcagggcccagcttatgctaacatttctacctcccccctgggcaggaatcgggcgcctgattgctgagtgtcatctcaaccccatcatcctgcccctgtggcatgtcggtgagcctggggacggggacagagagatggcatctggggtggggggcctgggactccctctggtcccaggctgccctgctccaccccacgtctggccttctgtccactgtgctgcaggaatgaatgacgtccttcctaacagtccgccctacttcccccgctttggacaggtgggtggggactgctgaccttcggctgtctgcctgtctgctgtctgctccgtgtctcccactcagcactatggaggccagctgcaggaggagctgagcatgaggctacagcaggggacagagtggaacatagacagggacttcctggcaccgagacattaaaatgagagcagaggaagtcaggctggggcagaggtgggctgtggggtcaggacaggacaggtcatctacagcacaggacccaggaccaggaccttgttttagaggaagagtggcccctggggagtgtgtggcacagcagggccggggcttagcttctggctcccgggttgcttgggctggggctgtgggcactcctactgctcctcatcactcttggcggccaccccacagaaaatcactgtgctgatcgggaagcccttcagtgccctgcctgtactcgagcggctccgggcggagaacaagtcggctgtgagtttcctcctgggtcccccgtagctgtccccggaccccctgctgctggcttccagcagggtgcctccaccctctccatcccgtcaccctcccagggcaccctcccagggcaccttggccaagcttcccgaggggtgcaggccatccctggtcctttccctcaggtggagatgcggaaagccctgacggacttcattcaagaggaattccagcatctgaagactcaggcagagcagctccacaaccacctccagcctgggagataggccttgcttgctgccttctggattcttggcccgcacagagctggggctgagggatggactgatgcttttagctcaaacgtggcttttagacagatttgttcatagaccctctcaagtgccctctccgagctggtaggcattccagctcctccgtgcttcctcagttacacaaaggacctcagctgcttctcccacttggccaagcagggaggaagaagcttaggcagggctctctttccttcttgccttcagatgttctctcccaggggctggcttcaggagggagcatagaaggcaggtgagcaaccagttggctaggggagcagggggcccaccagagctgtggagaggggaccctaagactcctcggcctggctcctacccaccgcccttgccgaaccaggagctgctcactacctcctcagggatggccgttggccacgtcttccttctgcctgagcttccccccgaccacaggccctttcctcaggcaaggtctggcctcaggtgggccgcaggcgggaaaagcagcccttggccagaagtcaagcccagccacgtggagcctagagtgagggcctgaggtctggctgcttgcccccatgctggcgccaacaacttct

SEQ ID NO: 139600 - DNA, 1815 bp, Homo sapiens
ccttgggtaacgtggagcagggagtggtgtgatttctcaattaaagaaagcccacaggacccaccagcagttcctgggctttccgactgagaaccccggtggccaaacagcagcaaggtcctgcccacaagggaggggaggctgggcgagtgtgtataccaaacaggttagggaagctgattaaaatctcctcagggcctaactgggaagggccagaggaagctggggatgggagtggagggtaggagcaaaaggacaaaggacatctgtaggttgtggagaaaaagggatggggtcggggccactgtggtcctaagagctcaaaagacttcaatgctcgatgcttcctccagcatgttctgagatcctcacctctccccttccgccaaaagcaggtggggggagggtcccgtccagactggacatagccgactctccttttctctggctgggaggcctgccacaaatgctcttggctgccccaccccctccccgcagcttccctgttccctccccagttcctcttgtctgtagggtgggcaaggcggctgactcctactcctgagttaccacaagtcagctgcctgcagatctccccaccccatgactgccttccatgtcttctcaccctgccctgagagtgctggagggaagaggtgagtctcccaccccacccccaccaacacacagttgcgctccaccatactgaacctgactctcagtgagactttgctggccctgagaatgcacggggaaggtggctgtcccctgccttggcccccatcacttgccaaacctcctcagatgtctcccctatttccctaatagctgagcattgaggatttcacagcatatggcggtgtgtttggaaacaagcaggacagcgccttttctaacctagaggtgagagtcctctcccagccaggggccatgggggacattctgtgctccttctcccagcataagaactgtactctgacctcatatcagggttacttgggtctgagtctcttctgggtcaaccatcccccccaaaaacaacaacaacaacaaaagccacctcatactcttagggagcagagacgctggctttggggtagaaaggcctggggcctgaatgtcaggggctggggtgtgggccattttcttggtgagcctttatgggtatggcttgccagaggagagctgccagagaggtgtggggggctgggccaggcccactggcccctggctaactcaccttttgcctctcccctgtccccagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccaggtactgcccgcatggcccagccaccagcctcggggcccagagagcagcaaggccctgggctatggcatgtggtggcaccgtttggctaaagatgccagtactccccaccccctcacagcccttccagaaggtgccctgtgtggccagaagaggaggggagggcctcttctgtgactcaggagttggtgcctagcactgagctgggcctccagagatgaggcagatgtgagccctgcgggtggggagccttctcacctagccaggcccttgtcacagagcaggtggccaggacttgagtgtgactgagaagcctcggggtgggatgggcttccaggagggggcactgaggtaagagtg

SEQ ID NO: 139601 - DNA, 1756 bp, Homo sapiens
ccctgtggtgtgactatttggagtggctgactctgggggcagggctaggatgagcactcaagtcctgcctccccattccaggggcagctttccatctcgtcctgtgaggcttgtgggtggcagacttggacactaagtctaaatgaccctaagtttgagggactaggaatgtcatcagggtttagggggcatcagggaaggcttcctggaggaaaggtctcctctggctgatgggactttgagatagtggacagggtgtcctgttgggaggggaaggagggcacgacaattgggttcaagtgtgacactctcccagggctgctgaaagaaggctggttgggtgtttctgcaggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggcaagggcactaggctggggaggactgtgccaccacaggtgaccttcccatcactgtgggtcgcaggtggggcagggagccagggtcaggtctgtgttttggggtggggatggccatggtctggttggggtctgggcagcgtgaggatgtaggaggtgtcatggcatggggtgctgttggagggggagttgctcagacttctgcctccccatgcttgcgagtctttggttgggaccttggttgttaacacctcaaggttacctgggaacctgtcacctcccccttgagcaaaacctctgggactttgtgtgggcaaataccaggccagctatctgagccatttatggggcaaccatgcccttctgtttgctctcgcccccaaagcccagcccaggcaccttagtgaccctaagagggagtaaaaggaggggcagtgagctcaggggaaccagaggaaggacccccatgctggtggcaagggggacctgggtcctggcttccagctctgttccgaccttgcaatgtgactggatcctcagttttcctatctgtcaagtggggacactgcttcttcaggtggctgcaaggacccaaggcagcttaggtaggagcagagctgaggaacttgttcctctaagatgccaaaggccctcccagagcctcacagtgcgcctctttctctggccccacaggctctcactgacctatgaacgactctttggtaccacagtgacattcaagtgagtcctgggggtggttgaggtatgggtgggctggtgtggccccagcctccccagctcacctgacatccctgccaccttccccaggttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccaggtatggagcgggcgtggcccagcttcaggtgggggagcccaggctagtggttgagagacgaagagaggcttgggcttgggcatgtagttgagagtcctgtccctgc

SEQ ID NO: 139602 - DNA, 1065 bp, Homo sapiens
cctgtcgggcatcatgtctgtgaacgggaagaaggtgctgcacatggaccggaacccctactacgggggcgagagctcctccatcacacccctggaggaggtgaggctgcccaggcccaagcctatccctgttaacctcccacatagcggcacagggtggaagtagctccccaggtgcctggagcaggaggaggtggtccctgaggtgtctctctctctcccttctgcttacagctgtataagcgttttcagttgctggaggggccccctgagtcgatgggccgaggccgagactggaatgttgacctgattcccaaattcctcatggctaacggtgagggacaggaaggaggtattgcaggtcgggggtgatagggaagacccgaggacggtcaggctccagaggaggcacggccagaccagctagagcctctggagagagccgtgctgatgttgcccttgtgcacccccacagggcagctggtaaagatgctactgtatacagaggtgactcgctacctggacttcaaggtggtggagggcagctttgtctacaaggggggcaagatctacaaagtgccgtccactgagactgaggccttggcttccagtgagtgtgggccccctgagccagagaaatcatggggtggcagggaagccaactgtctttgggatgggtggctgtccagaataaggcacccccttgtccaaagtcacatttcccgtgaaggaccagagaggcccttcactctgtattccctctgccccatgtcatgctgcacggctggctgccaggagggaggtcctcacacagcagggatgtgatgtggaggggaacggggctccttttgaaagacttgagcctggccaggtgcggtggctcacgcctgtaatcccagcactttgggaggcctaggcgggtggatcacgaggtcaggagttcaagaccagcctggccaacatggtgaaacaccgtctcatctcaaaatacgaaaaattagctgggtgtggtggcatgcacctgtaatcccagctactcgggaggctgaggcaagagaatggttt

SEQ ID NO: 139603 - DNA, 3273 bp, Homo sapiens
agcccatatttatacccgctctacggcttgggcgagctgccccagggttttgcaaggtgaggacatgggttttttcagttggcatagctgagtaggactagggccaggagtggagatggccgccttgagcattttcttggtagtatttcctcctttccaattcgtgctcttcatttacttcactccatccttgggtgatgagggcacaaccccagtgcactgaagtacagaagtctccacacttgaaaaaacgagtctccacaaatgtgacttgctcagttcccggcagcaccaggactgggcccagggtcccagaaccttgagtcagggcttagctgggagctgacctatctccagagagtccattctggtccctcaggctgtcttggtgcggagcactgatccctcatgccccctcccgctggcccttggcagtgtattctgagcagaagctccagagaggaaagagcccgcggagatggggccagcgttcacggcagtgacagagctgggatgaatcccggcgtctcctacctgctgcctgcctggggcagccttctttgcactttggtggaggaagggtgcagtggaattggtccccgtttctcctgggaggggccttcaccggagctgctctcaccacagattgagtgccatctatggggggacatatatgctgaacaaacctgtggatgacatcatcatggagaacggcaaggtggtgggcgtgaagtctgagggagaggtgagcccttcccgtgcatgcagtgcagtcccatggttgaggcggggcttggtcactttctctgtgctgtcgagtctcctgctgcacagccccaagggtcttggagctgggaactgggggtccagaagtcttcagagtcatgactgtgggtgagaggtctctttcagaggccacatgccatgtctgtggtgcagaaagtgttcttgatcacagtgcctctggggggcgggggggcgggcacccagcccgtgcgtcaaggcccacctatctgagcggcagggtagggccatgcattcaggaggggcagtagtgatggctccgaggaacgtcttgtctgccagagctgcctgcccttgctgtgagcgcagccccacgtctacctaagggagggatgtgacaggggcgaggacttctggtgccttctcaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcaggtaggccgggcgctggtacagcttcctctagggtgttctctttggggttactctttttctccccatcagtgtgggagctccctgccttacctctctggaaaaaaatttgagccacattgtagccaccacaacttggagccctagggtttgggtggcctggactctttccctctgggagggtggcggcttggatgctacctgctctgcggggctggggaggggcagtcgggccagacttgtgtccagccactggaacccctctctgcgtatggccagcgcctctggcctgagttgacggagctcttcctgtggccagacatctacgtgtgcatgatctcctatgcacacaacgtggcggcccagggcaagtacatagctattgccagcactactgtggagaccacggaccctgaaaaggaggtggagccggctctggagctgttggagcccattgaccagaagtgagggactgggctgagcccaagggggagagggagggagcccagcagctgggcttagggaccaggaagggcatggcccattgtgaggcctgtcccctcccctctgtctgcccctcaggtttgtggctatcagtgacttgtatgagcccattgatgatggttgtgagagccaggtaagcagctcgtcccagccctgggctcctggctgcccgcccaggatacctgtctgactcaccctgggcgctgggctctggctgtttccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattcctcccccctaatttattctaatttattaactttgacccaccctttctgagcctgcagccttcccgtgtggcctgagggctgtcgagtgagctgccccagcccctcccagcccttgcccagcctgggggagtggggaaggcttgggcatggccccgttggaggttgatttgctgttttgtttcttgtctttgtgttctgtggtacttgctgagagaaaagaaaagtgagccaagcagaaggaggtgggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttgaaacctgaatctctggatcttgatggttatctcccaaaagctgggtacctggcagggctttggctgcctgggttggggctctggcttagcttcactctggactgtaaaaggtggcattcttcaccagggaattcctcacccagagcacgctggggccaaattgacttaaagcttaaggctacccagtgagtcgatgctggcaccaggactgcagccctcagtgctcaatgcagggggagtgtggtggagggcgggtgtcaacgtg

SEQ ID NO: 139604 - DNA, 1023 bp, Homo sapiens
gacgggtgccagttttcggcttaatgcgggggaactagggcagccaggggaccagcgttggggtcaccaggaggaattagagggaccggggcccagccttggctcgggttaacgtcgaggcagcgcgaggggctggggaattcagcctccggggtccacaggagccggcggcgggggctggggcgggagtccacgcaggaccaggggcggtctccggcggggcggggcgggcggtggtcacgctccgggccagctggcgcgcggcggggcggggcatccgtgcgtctcctggtggctgacgtcacggcgcgggcgtcagctgactgttcggccgccaccgccgctgccgctgccgctgtcgctgtcgccgccgccgccgcccgccgccgccgccgccgccgccgccgctgccatggctcaatacaagggcgccgcgagcgaggccggccgcgccatgcacctgatgaagaagcgggagaagcagcgcgagcagatggagcagatgaagcagcgcatcgcggaggtgcgagccggggagcctcggagcatgcgcgctgcccaggtcccctggcggccccgcgccacgctccggccctggaagccctggggcggtggccacggagcgcgggcggcgcgccggggcaggcccctggctcgctgacttccagcagggcacacagaagcaagccagcgacagtctcatctgtgaaatgggcctggagccgggcgttctccgaggctgaggccactagctgatgaccggcctccggcaggagggagccgagccagtgtttctgttgggaggcacggcggggacgggcctctcgtcgcctcgcctgggcacccagcgtcctggctctggcccctcggccctcagagccaggcctctgccccctcggccctcagagccaggcctctgccctggtcctatggacaccgggcagggcggttcgtctccccctggagaggcggggaggcctgagccagacctggcaagtccactggccaggaggctccttccag

SEQ ID NO: 139605 - DNA, 1132 bp, Homo sapiens
gttgacacaagcttcttgcctgatcgagaccgtgaggtaaaggctgcctggccctgaccccggcctcgactccagccctggtggagacccttgcttagggagccaggctctgcgtgcaccctgagcagccctgggcctcacctgtctgcctgctccctctcccaggaggaggagaatcggcttcgggaagagctgcggcaggagtgggaagccaagcaggagaagatcaagagtgagtgtttgcggagtcagacgcgaggggcctgggcccaagccagcttccctgtccacagtctcctgggtggtgcgctgagccccaaggctgctctcagtggggctggagaccaagaggcagctctgccttgtaggtgaggagatcgagatcaccttcagctactgggatggctctgggcaccggcggacagtcaaggtaggcagcgtgcagcctgcttcctgctcaccatgggcccagcctccctcaggttccgtgggaaggaactgaccttcctgacttgggaagccccagggatcctgaggataactggctccagggcctggccccctgtctggggagtgaggcccaggcctggctgaggctctgcagcgtctggcagggccctctgggcctctgccttgttgagagcccttctgcaggcttccgccttcccttcccaactcctggattcccggatacagatgagaaagggcaacaccatgcagcagttcctgcagaaggcgctcgagatccttcggaaagacttcagtgagctgaggtgtgaggtgtgcgtgtgtgcacggtggtgtgtgtggcacctgtggctccagcctgggtgccagacacccagtgtgatgtgggcgctgtctgggcaagcaagcagcgtgctgggcactctcctcccaaaagagggggtcaggctcctcttcccttccctcccaccagagagctttgctgagagcggcctgccttggttccttagcccaaaggtggagggtgctgggcgccagtcctgtgctcactaaaccatggagcttccctcacagccaactggccgctgcttcccagccccagcatgggctctcctgggctggctgtctcctccctccctgggcaggggtgctgtcctcttgccca

SEQ ID NO: 139606 - DNA, 1002 bp, Homo sapiens
gcgtcccctgccgccgcgtccccctcggccgggcgtccccggacgcccccgccccgcgcggtggtacggtccgggtttaaaaggctccggcggcccccgggccagcccagtgtgtgggcggcggcggcggcggctgcgcgcttggggcccggggcgcggggcgaggccgtggggacgtgcgagcggggccgcggtggggctcgggggcgcgtccacgtggccagagggcggccacccggagccagcggagggacaggtaggtggccgtcatcgtcgccgtccgtgcggggccaaacagctcggggcccggggctccggcagcccgggggtccggctcggcctgtgggggtcaggccctatccctgcccgtcggcgccggcctgcccgactccttgtgccccgcatggtggggacgccaacccaagaccaacaccctgcccaaagaggaccctttgtcgcaggggagcggcccctcggaggatcaacgctgtacttccctcccgctaagggctccgcgagtccgccgaggggtgccctgatggggcccgggcaaaccggaccagcagcacggtggggggtgtggggggcggccgctggacccccgtctctgcgtggggctgccccttcctcaggctctctgctggcccagctgtacctgtgatgcccgaggttgccacttacaggtgggggctgggcctgaaactgcctccccaggtctccctcccgacctgtccccagcctgttcctaggcttgtgttcccggggtgtagaggaggtgaagacaggatgtggcctctcttttctttggccttcctttcttctccggctgttgcatgaggggtccagctgacaaaagagccctggagaggtgatcaatctgagctgaaactttgcagtttcaagctgggcccgctgcttgttcctggcaaatgccttatttttcctttctctctcctgtgcctccttggtttggttccctgcaccaccccccgctcccccccc

SEQ ID NO: 139607 - DNA, 1068 bp, Homo sapiens
ctgctatcgtggggagggcactctggctctgccctggctgctgaacaaggagctgccctgcatcaacaccgtgagcccctcatcaccccacactggtcctctgccctgtcccaggtctaccatgcccagcgtgggctcacggccagtcatcctgtcccaggctttgccatggccctgggagtggcacctttgccctcccacctgtttctccctcccaggggtccctgccctctccttgcctctctctgggctgcccagtgccccacttctgcttccttccgttcccagctcgttcctccttgctccgtctcccggttgccccttgtcttgagccaacaagagtcttgtgggcccaggcttcgctcctcgctccctgctgtccctcctctgtctccctccgcagccaccaatttcctggagcaccctagggcgagcagtcagtcctggctggaggggaccgggttctagatcccgctctcttctgggactcaggaactgccggcctccatcttgcgcctgggagctttgactctcacgggttcctcctctgtttcaccagcccatgcagatcaacggcaacttctgtgggctggtgttgaaccagcctctgggaggcctgcatgtgatcgaggggctgcccctgctggccgacagcaccgacggcatggccagcgtggccgcctacacctaccgccagcactctgtggtcttcattggcacgcgcagcggcagcttgaagaaggtggcccccagagccctgggcatgtgggggtggggacagtctcagatatgggacaaggctggtggtgggaacacacgggagagctctgaggacaggacaggagaggacacggctggtgcagggagggagatttccctggctgggtcccaggcgcctggccctgctcctcgggtcgccccttggccgcccaccctcaccattgccagttcccactgtggactgaattgccagcttcgtatggctctggggacagagaacagacctattgtggagtctccctgccacgagagcaggcctggggctgagccagcattgctgggtcctct

SEQ ID NO: 139608 - DNA, 1966 bp, Homo sapiens
cagccacacccagccgtgcccttgcggcctccccccgccctcctccactttctccagctaatgagtggaacctccaccccgagtgacgtccctcgggccccaggggacgcggccaaggctcgctgttgcctggcactgtgagctggacaggcctgggccctcccggggcagtggcgggaccggctctggcccgaccccgtgcaggtgctgccgcgaaggggcctgtctgggcgcctctgccccacacggctttgctgaggagctgagcaagtgtgtccaggtgcgggtccggcccaacaatgtgtcagtgacgtcacctggggtgcaggtgagcagcttgggggtgcccggctgggtgtgcacatgtgtgctgggagtccgccctgccctgagccctctgcttcccccagctgaccgtcaccctgcacaacgtgccagacctcagtgcgggcgtgagctgcgccttcgaggcggcggcggagaacgaggcggtcctgctgccctccggtgaactgctctgcccctcaccctccctccaggagctccgagctcttaccagggggcatggtcagtgggttggggctgcccaggatggggcagagtggggcctctccctacccccagcgagttcacggccaccccgggactgctgcaggggccacccgcactgtgcggctgcagcttctctccaaggagacaggcgtgaggtttgccggtgctgactttgtcttctacaactgcagcgtcctccagtcgtgagtacctggccagcacccgtccctacccctggggatagaggggacctctgggacaggcgacaccttcagggcagctgtttctggggcatcaggggctaactgtcaggccctgatagcccctgacatccccacatctctctgtcccctgatatggctgccttcttccttcagttcccgatgtgtcctattggggagcagtgaggggcagtgcagcctcctctgttatttctgaagccacttcccccccaggtgcatgtcctgtgttggcagcccttacccctgccactggtgtaagtaccgccacacgtgtaccagccgcccccacgagtgctccttccaggagggcagggtccacagccctgaggtgaggcgggcgccgcatgtgaggggctgggctctgtggtgcgggcggggccaccggcttctatgcgttctcggtttctttgagccttctccaggttgggcctggagaagggtggccctgtgtgcagctgacaggtgctttccccgcagggctgccctgagatcctgcccagtggggacctcctgatccccgttggggtcatgcagcctcttaccttgcgggctaagaacctacctcagccgcagtcgggccagaagaactatgagtgcgtggtgcgggtgcaggggcggcagcagcgggtgcctgccgtgcgcttcaacagcagcagtgtgcagtgccagaacgcctcggtgaggtcccacccgctgcctcccttcggggtctgggctgtggcgtggtgtggatcgttcttgtctatgcccagctctctggcagggaactgtctgagtctcctgctagggattcctgtacctggaggaggggggcagctggcaaaaatcttgggtaggggttctgcacatcttatctggggtcccatgggttcctttcctccagtactcctatgaaggtgatgagcatggtgacaccgagctggacttctccgtggtctgggatggagacttccccatagacaagcctcccagcttccgaggtgaaggcatgggccagggagcttccctcctaaggcaattggcactgctggggtcgggtctgggggccctagtgctccccactttccacttttctgccactgcctgctccgtcagcagtgccttctgtgcctgcagccctcctgtacaagtgctgggcgcagcggcccagctgtggcctctgcctcaaggct

SEQ ID NO: 139609 - DNA, 1005 bp, Homo sapiens
tccccgcttcaactgtggctggtgcatctcagagcacaggtgccagctgcggacccactgcccggccccgaagaccaactggatgcacctgagccagaagggcacccggtgcagccacccccgcatcacgcaggtcagcctccctcaccgcccctgcccactgccaacagggcccctgggagtctgagccaactctctcactgcccatcctgctccacagatccaccctctcgtggggcccaaggaaggaggcacccgggtcaccatcgtgggtgacaacctgggcctcttgtcccgagaggtgggcctgcgggtggctggcgtgcgttgcaactccattccggccgagtacatcagtgctgagaggtgagtgcggctctgtgggtgcccgggccgtatgtggcctggccggccctgacgctctctgagccctaggatcgtgtgtgagatggaggagtcgctggtgcccagcccgccgccggggcccgtggagctgtgtgtgggtgactgttcagccgacttccgcacgcagtcggagcaggtctacagctttgtggtgcgtggctgccggccctaccccttcctgtcccttctctctcccgcaaggggcgtgtggagcagcccggcccggctcctcccctcagggcagcttctcccgcagaccccaacgtttgaccaagtgagtcccagccgtggcccggcgtccgggggcacacggcttaccatctcaggcagctctctggatgctggcagcagggtcacagtgactgtgagggacagcgagtgccagtttgtaaggtgggccggggccctgccagctttgggttgggcatcgtgtggggggccgtggggacgggtggctgagggccctgggccacccgctccaagcaccctgcttgccaatgtaggagagatgccaaggcgatcgtgtgcatctcacctctctccaccctgggccccagccaggcccccatcacacttgccattgaccgggctaacatctcc

SEQ ID NO: 139610 - DNA, 1086 bp, Homo sapiens
tgattacgcctgaccaggagacaggcaccaaattgtggcacctggtgaaaaaccacgaccatgccgaccatcgcgagggggaccgtggcagcaagatggtctccgagatctacctgacacggctgctggccaccaaggtatgggcctgcctctcgccaccttggcctccgcccagaggttgtcccggccttacaggggaggggccatggatcatttgcttccagtgggcctttcttcgggtctttgctgtgggaactctgagccttagataaaggccatgtctgtctgagagaccactggccctgtagggaagcccctctctttgccaagcctttctgcctccatctgtcctgctctggggacatcccgacctggctccctcatagcctgtgacctctctgccccacacagggcacactgcagaagttcgtggatgacctctttgagacagtgttcagcacagcccaccggggctcggccctgcccctggccatcaagtacatgttcgacttcctggatgagcaggcggaccagcgccagatcagcgaccccgatgtgcgccacacctggaagagcaactggtatcaccccgtgctgggctgccagcagcctgtctggagactggtgggcggaagacgctggtggctctgctgagacccagggcctggagtagcatccaggcaggagggaatgaggcctggcctggggttgacactgacggtgccatcaagccaaggggcctgttgcgtccagttctggagctggactgcctgggtgggtgggatggtggtggtgaggcctttgccctctggggtcttgcaccaggtagagatgctggtggtcggtcgcaggtggtgagagcggtgacaggagaagctgcggagggggttgagccctattgagaacagaagttcagcagagacttagaggaaaggccgttcaccctaaatgtgttgctctcaccacctctggacaagatgtgagccggccggacaggaaagagatgtgcacatgggaggggccccttggggctaactagggagcctcaggcgcacgtccctctgttgtccacagcctgccgctgcg

SEQ ID NO: 139611 - DNA, 1088 bp, Homo sapiens
tgcaactaaagaggagagaacggggggtctgggactgtcagacagggccagattcctcagaggaggcagaagacacagagtagtaaggcacggccgccttggccccacagggcgggcactggacggagcgggcgctgaatggggcggctgaaggagtcggagcaggtgcagacaacactgaggacgtttggcagtaggctcaggaggaggagtgttctagggcccccaggcccaagtcaggccctggcacaagcctgagtccagccctccaggtgctcagagagaatagggccccgagatgcttgagggggaccctgtggtccagcgtggcacagccacaattctgaggaagctttggaggcctcaccccaagtgctgctggtaccgtgaccccgccttggaatgggtggggtcagccatggcaagggtgaggtgccagaggccagaccgaggctgataatgctacacaaaggagcccagacgggtggcagggcccaggacagctcaagaagaggcaggtgagtgagggtggcgacatccggtggggggacacatatttacagatggagacagaggcgaagttcgattcaataaataggcagagggatataaatagcagggagggtgggactgtcccaacacctgggcacagggcaggagggtgggggtattgctgctgctggggtgggggctcgccctgtcacccctccccctgcagggcccaaagcaaggcactaatgaagggggcctgggtgtgccgggggcatcgtggccagggtgacctgccccacgatacccaatccagggctcagcccggggacccaggcttgagccagccactcccctggatgggaggacggcacaggactgagaagccccctcctcaccgattccaccaccttagctgtcgctggacacgaggctgatgatctgttccagtttctgccgcaacttatgcttccgacaagaggcatctcggtccagagccgtgagaatctgggggagaggagtcccctggagctgggctctgtagggggcgcagctcctgccatgcaaagtccccacttcccagctgggctcctccctcc

SEQ ID NO: 139612 - DNA, 1057 bp, Homo sapiens
tcgtggggcaggtcaccctggccacgatgcccccggcacacccaggcccccttcattagtgccttgctttgggccctgcagggggaggggtgacagggcgagcccccaccccagcagcagcaatacccccaccctcctgccctgtgcccaggtgttgggacagtcccaccctccctgctatttatatccctctgcctatttattgaatcgaacttcgcctctgtctccatctgtaaatatgtgtccccccaccggatgtcgccaccctcactcacctgcctcttcttgagctgtcctgggccctgccacccgtctgggctcctttgtgtagcattatcagcctcggtctggcctctggcacctcacccttgccatggctgaccccacccattccaaggcggggtcacggtaccagcagcacttggggtgaggcctccaaagcttcctcagaattgtggctgtgccacgctggaccacagggtccccctcaagcatctcggggccctattctctctgagcacctggagggctggactcaggcttgtgccagggcctgacttgggcctgggggccctagaacactcctcctcctgagcctactgccaaacgtcctcagtgttgtctgcacctgctccgactccttcagccgccccattcagcgcccgctccgtccagtgcccgccctgtggggccaaggcggccgtgccttactactctgtgtcttctgcctcctctgaggaatctggccctgtctgacagtcccagaccccccgttctctcctctttagttgcatgagtttttctttgttcatggaatgttttttcctgattaaatgttggggaaatgccatccatgtggggctctgtccttggggcaggtcagtagacctgtggatgctgcatgagctggagccccattgtgggagaaaggaccactccttgcagggtcccagagggtttggggaggttcagggccatacccgacccatcagcaaaccccggtggctctaccttcaagacagattcaaggtagatagattctcctcccttccaccac

SEQ ID NO: 139613 - DNA, 1970 bp, Homo sapiens
aattgggccggggggcggggccggggcgcggacggggcaggagggcggggccgggaagcgcgggcggcgggcgcgcccctctcgctgcttccggcggcggcgggcggttccagcgcgcgcccggggcggcggcgcgcggcggggggtggttggggtgcgcgccggcccgagtggacgccgtcgcgaccgccatgcagctgacggtgaaggcgctgcagggccgcgagtgcagcctgcaggtagggtccccgggccgggccgccgggtccggcgcgctctctcgcccgctcctggcagggggaccggcagggccgagggcgggcacggggaggccgggccgagggccgggagccgggagagctgccctcgggggcggacgcgtgggcttcgccgtctgggggccgcgggctcaacccttgcctcccaccctccgcgcggccaggtgccagaggacgagctggtgtccacgctgaagcagctggtctccgagaagctgaacgtcccagtgcgccagcagcggctgctgttcaagggcaaggccctggcaggtacccagggagaggagacgcccggggagccccgcaggaagcgggaccggggtgcgcgggccgaggccagcagccgtgtgtcgggtcggggtgcgggcgccaagcgccacatgaccccaagggaggcggccgcatgcctcacagccggatgccgcagcgctccgctcccgccgcccgaggcggcctcgcgccccgggccacccccacggcggtggaggaggaggaacccatcgatctgtctttggcagatgggaaacgactctcggattatagcatcgggcccaactccaagctcaacctagtggtcaaacccctggagaaggtgctactagaagaaggcgaggcccagaggctggccgactccccacccccgcaggtctggcagctgatctccaaagtcttggcccgccacttcagtgcggcagatgccagcagggtcctggaacagctacagagggtgagaagggtaaccctgggcatcctcttcaggcccagttgctcccagcccctacctctgttgcagtgtatgccccccccccactggcagcccctgaatcttcctgcccttctctccccaggattacgagaggtccctgagtcgcctgacgctggacgacatcgaacggttggccagccgcttcctgcaccctgaagtgactgagacaatggagaagggcttctccaaatagaattctcggagcatggggaggtgcccaacgccaggctaccgctgcatgtcgcactaagtgtgttctcctgttgcagttgggctcatcatcgtcatagctggcatgtacctggctctggccaggtgctaggcactcctcacagcttgacctgggtttgcttccacaccctcagaagaggagagccggcacagcagaggcaccggcgatgaagtggcacagccccagtcggaatccagcggcttctgaaagtgccttggtgtgagaaggaggaaggggccgcttggagagctgggctctcgcatgtcatgtttagcccactgagaatataccctcaggtgactccctcccgatcctgaaagggaaagcagctgtcacctgacttctggcgggtccaacatagccctcagcttacctctgcaggaggccgagtgacagccagccctggaaccccccgacccccgcagctgctgcagccagtgtgccagtgtgcgttcgacaaatggaaaagcagattggggccagggagtcagcaaggcaccccagctctgtgatgtgactttgggcgagtctcagtgccacttggtccccagccatggactctatacagtgagggccactcaccgacctgagtcagtgtcctctgtctcacagggcccctctcccttctgttcagtaaacaaactgaagccaaaaatgaagccgtggccaagcgtgacccagagatggggtgtcc

SEQ ID NO: 139614 - DNA, 1126 bp, Homo sapiens
ccttctgcagcaacagctgacaccccttcctcccatgctgcaggatgaatgaagagaccagaaagctcttcagtgagctgggcagcaggaacgccaaggagctggccttccgggacagctgggtgtttgtcggggccaagggtgtgcagaacaagagcccctttgagcaggtatggggggtgcctggcatcacccccaccggggcagcctgtcgccccttctgcctgcatgcgacgagcctccccagctgctcacgccccagcaggggaccgtccccagtccagctatgaggggtgggccagtgcagctgatgccatgtttccctgggatgggtggaggggccaagtgccctgagagtacaccgttggccaacacagcacagttgactgacagcctgggtcctggtccactcctgtcccctgtccctgagggccaaagtcatgactttctgctcccctccccacagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcaactctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggag

SEQ ID NO: 139615 - DNA, 1048 bp, Homo sapiens
tgaggtagttacgtcatgagggctctgccctcatgaatggatgaatgccattattatgggtgagttagttaccttgaagttcagcccccttttttcctgcgtctcatatgcttgcttccaccttccacctttctgccacgggatgaccctcaccagatgccggcgccatgcttttggacttcccagcctccagaaccatgagccaaatgaatctgttgtctttataaattacccagtctgtggtattctgttatggcagcagcaaatggactaagacaagcctctactgactacccagttccaaagccatttccacatttttaggtatttgttacctaagcaccacacttcctggtgccaaaacctgtatccatttcctggaactgccatttcaactgggtggcttaaacaacagaaatggattctctccccattctgaaagccagaagtctgaaatcaaagtgtcagcagggcgttactcaccctgaaagttctacaggagggtccttcctgacctccccaggttccagtggccccaggcataccttggcctctggctgtgtcactcctgtctcttcctccactgtaccatggctgtcttccctctgtgtgtctttgtcacttctgttcttataaggacatcagtcatgttgcattaaggacccaacctactccagtatgaccccatctgaactgcaaaggccctatttgcaaacatcacattctgaagtaccacagattagaacttcagcataccttgaggggacagaattcaacccataatagaagccatcctgctccagtcctcccaaccaacccccatcaaaatcgggagacaggctgcaccccctgccacactaccccctgccacactgcctttgctcaggttggcctcatccatgcagctagacccccagcctgacttacttcacccctgctttgttcctggctgtgcagtggcccaggccagccctcagcatcctttcttttctcccaccagtaacagaaaatccttctgtcttgggtccctgtggcctcaccagtagga

SEQ ID NO: 139616 - DNA, 1514 bp, Homo sapiens
ttcaaggagccctttggcactgagggtcgcgggggctatttcgatgaatttgggatcatccggtgagagctcttcctctctcctgggaggctggcacagggtggcagagccagtcaccctgcagggctactcttccctatcttgggggagctcctcctcaccctgcagttcaaaacctaagtgtctgagctatcagaccgggctggaaagggctggacccctacacagccaagcaccccacggttttatgattcagtgatagcatcaccatgtccttccttgatttaaggggacctggaagacaagggggatcaggaagtgagtcttgcagcttgtcactaggaagccttgtttggggtccccatgcccttgaaccaggtgaacagggcggggagctaaggcgagctctggcctcttccgtccccagggacgtgatgcagaaccacctactgcagatgctgtgtctggtggccatggagaagcccgcctccaccaactcagatgacgtccgtgatgagaaggtagggggtgcaccccagtccccaggagcatgccctgtcgcaggcccatctgtgacgaggcactgagctggggtgtgcatgcagagcaggtgtcctcaaccccggagaagtcaccacctctgagcacagcgtggcctcccggaggtgacctggactggcagtcatgaagcccaagttgtcatgtcccaggcctgacagtcactatgtgaccagggaaggccattgcctctctgggcctcagcttgttcatcagaatagactcgagatggaccagggtggtcctggagggtcctcagggaggggccctgagctgggcctctggcagggtgagcagagccaagcaggggcctcctcctgccctgagggctgcacatctgtggccacagtcatccctgcaccccaactcaacacccaaggagcccattctctcccttggctttctctcaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggtaggtgatgccttcgaggcccagcaaggcagaactgggcatgccctgtgtgcgggcactggagctcccactgagacactcacgcactggtccacaccctgagagagctggtgctgaggctgccctttccgccacgtaggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgaccta

SEQ ID NO: 139617 - DNA, 1162 bp, Homo sapiens
ggttcccgggggagtggcgcggcagaaggccccgcccaggagccgagggacagcccagaggaggcgtggccacgctgccggcggaagtggagccctccgcgagcgcgcgaggccgccggggcaggcggggaaaccggacagtaggggcggggcctggccggcgatggggattcgggagcactacgcggagctgcacccgtgcccgccggaattggggatgcagagcagcggcagcgggtatggcaggcagccggcgggccggcctccagcgcaggtgcccgagaggcaggggctggcctgggatgcgcgcgcacctgccctcgccccgccccgcccgcacgaggggtggtggccgaggccccgccccgcacgcctcgcctgaggcgggtccgctcagcccaggcgcccgcccccgcccccgccgattaaatgggccggcggggctcagcccccggaaacggtcgtacacttcggggctgcgagcgcggagggcgacgacgacgaagcgcaggtaaccggccgggcgggcgccgcgcaggcggaggagcgtactgtcccgcgctgcgccgcgcggcggtaaaatacacgctgtttgttgtgcttgagaaccgagcagaatcgagagggtcttaaccaatccctttataccccgcacctcctctcttgagcccctgagaccccgagagcgaaggggacttgccgaccggggtcacccagcttggcaaggggagggctggagctgaactccagcatctgcaccatctcccatgctccaggtcattgtggagttcccgctacagtcgggaatgagatggtcctgggcacgcagttccatgccccacaaggattttactcggttgtccagaattgatgctgtagtcggaatacaccaatgctttgagtaattttgtaatgtacaccctgaatgaaggctgcctaggagagagtggctggagcccagagccagcagtttctaacccatcaaccactccccaatgcccagccgttcacaaggagtgatttgggcaatcaggtgtcaccctggtgtgagaccccagaggaactctcaagaaaggggctaacttctcaatgctctcctgttcttctgccttgttaacgagcctttcttccaccagacagcgtcatggcagagcaggtggcc

SEQ ID NO: 139618 - DNA, 1072 bp, Homo sapiens
ggccttgcctcttcctctccccgtggccctgaaccttgagaatgggtagacctgccttagacttgccttagacctgtgtcaggctgcagctgcgacagctcagggaagctgtggggagatggcaaccccaggatgttgctctcaggagtgtcagcaggccatcttaatggggggctgggccagagccttggggtgctccctctgtggggctggggacgtcttgtctccatggacattccctcttgccagccatcgccatctggcacctggctcagcttcccccaagccaaggtaagcccgacagcatttccaccccagtgttggctgggagccttttcctagtttgtcctcatcagacctaagctggggtgcagtttgctagtgatcacattttagcaggacaccgtcaatcgtaagtgtacccagaggagatttataaggacaaagcctgaagccaggtcacatggggaagagttagctacaaaactggccacttaatctctggaggggggcgttggtggggtgtgtctgtgtgtgtctcagggggctggagatgcctgcgtgggaggagtgcacctctgaccaggtggcagagtggaaggactgagggctctcagctgagctgtgcacatggcgggcacaggaccggctggctgtgagtgggtgtggcctgtggcctgtgaagggtgggaggagggctgtggagctggggattctgggaagggaatgtcggcccagctgggaggttgtaccagatgacctcagcggcctcttcagtcctgaaaaaaacctcagcatctcctctgtcgttttgggccgtgacaggacgcagccatctccctgtgcacgctgagatcctgcaatgggccctcaaatcaggggctggcatcacccagcctggtcagccagggccactctttcatccttctcagttcttctcagccagcctcgccctgggctgacgaggctccgtcagctccccttgcccgtccttagggaatgcagctggaagatctcaaacagcagctccagcaggccgaggaggccctggtggccaaacaggaggtgatcg

SEQ ID NO: 139619 - DNA, 1030 bp, Homo sapiens
aggccgagcagcacaagattgtgatggagaccgttccggtgctgaaggcccaggtgagggccctcctctctgacccaccctggcactgggacctggagagtctctttggcgtctttttttttttttttgcttttgctttttgagattgagttttgctcttgttgcccaggctggagtgccactagtggcacgatcttggctcactgcaacctctgcctcccgggttcaaacaattctcttgcctcagcctcctgagtagctgggattacaggcgcctgccgccatgcccgtctaatttttgtatttttagtagagacagggtttcaccatgttggcccagctggtctcgaacttctggcctcaggtgatctgcccaccgcagtctctcaaagttctgggattacaggcgtgagccaccgcacccggcctctttggcatcattttgtagtggcctttcgtaagcttctgagccacttgtgctgctccttagacctctcggtgagcttggcattactcgccgacgtatctgtttcctctgcgccgctgggggctctgggaggacagcagtgggttctgctttgttcctgtggtgcctggcgcagtgcctggtgggtggctggcttgtggcgggcacatccctttctgttggatttgccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggtgggcctctgagagcgtgcccgtgtgagcagtgggtgcgacactggggggtcgccagtggtgaccccgcagtgggtgcgacactggggggttgccagtggtgaccacaggagacggatggctcctggtgttctgggttagggctcactgtggtccctctcctctcacctgagcttccaagagctgctttgacactagtccagccaaggagctttacagaaatgcgtgg

SEQ ID NO: 139620 - DNA, 1226 bp, Homo sapiens
gaggctaagggaggcatgccgtggtagcggcggctcctggtcttacatgagtggcctgtgagaccaggcctgccattgacagtcctgccaagtctccgtccccctccatcctccccttccctctgactcttctcttttcccagcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcattagtcgtgcgtatctttggcatagattctgagaagtgacaccactgagcatgggcgatggcgtagatggtacctgagcccccttcctccttggagcttggtttcccatctctccccaccccctatttccctagccttgccaaggaggaggtgggaaagcccgtttgggtttttgtcattcgctaggccatgcagttctctgttaagagtgagcttaaacatctttcctgaggctttaaggaccttttttagttctgcttctgaatgggctgctcatatcatatatatatatgtatatgtatagttgtgtatatgtatgtgtgtgtgtgtgtgtgtgtgtgtattttttttttttttt

SEQ ID NO: 139621 - DNA, 1077 bp, Homo sapiens
tcgaagtttttttttctttatgtagtcacatttatccattttttcccccttttactgctttgactttggagtcgtcgtgaccaccttgtggtctgtgggagggatgcttcacacatgagcacttttctttttctaacaccgaagcgtgctcttgtcttcaccaagagtgttgttgcccagtgtgactggtgatggctgtttcatcatattccagaagtttgtgatgccatttcccacactggccccaattaggaagaacagacgactctacttgttttgcaagattctggaaatttcccggggtgtcagagccctgggcattaaccctgcaattgtagcaaaggaaacaaagttggaagttgactccccagcacccaggccttccttcctgccctcctccaagctgccctggttgggaacgggatattgtgaatccaccctgaggcttcctcacagggcttcctgctatttgacagtgtgaggctggctagaattgggatatgaggccttctaaaaattaacctggcctgagggctttctcagcatctgggggcggggtgtgggggcggggagtgacctttcccctccttcaagccaggtgcccatcagattctacttgggaaaatgtgaaaggcacagacagcttgtctgctcacgggtgctgcacttaaatcctaatcttgcaatttttctacaagagcactttacattttttttttggagggagggtgtatgagtagacggtggctgctgtaacaaaggactgcacacttggggcttaaaacaacagaaactccttcacagtgttggaagccacagtctgcaatcaagttgtcagcaaggctggtttcttttttctttctctttctttctttctttctctttctttctttctttctttctctttctttctttctctttctttctttttctttctctttctctttctttctttctttcttttttctttcttttctttctccctctctctctccctctctctctcctctctctctttctctctttctttcttgttggatacagtcttgctctgacacccaggctggagtgcagtgg

SEQ ID NO: 139622 - DNA, 1697 bp, Homo sapiens
cccgatctgttccttcacgaaaatgagcccagtagcccgtccaagccagaaatggacttttagcccccaccccctgccaactctgccctttccctcatccccagttgcttaaaccaaaacggattcctcttcctctcatgatccaaactcctgagtcccttcaccttttgcctacactatcacagtgacctccttgctgctttcacactggagagcgtgggctccctgtgatctactctccacatggcagccagtgtcatctggtaaacctttgctgaaaccctgccatgcccttcagttgccctggaaacctgaactcatcctcagcctggctcgcagagccctcatgccgctgggacgtcacgttatgtccctctcctgctggcccgctgcacccagccgcaccacatgccggccgcacctcacacacgctggcctcttggcccttcctcgaacacacggcgcttgtccttgttgtcccctcatctttgcatggccgatttctttttctcattcagctctaagtttaaactttcaacagttctaagcgtatcaccttcttcatcttaaagtcctcatcctaaatcacactgcactgttttaactcccagcttggcagtccaaacggcctcatttattctgctttgttttctctctccttccaccagagggagagcagaggcctcctccagctcagtcaggcaccatcccccggaacagcggtctccaacctttttggcaccagggaccggttttgtggaagacgagttttccacagacggggatggggcgtgggatgacggttcggggatgaaactcttccacttcagatcatcaggcattagtcagatgctcctaaggagcacacaacctagatgatccctcgcacacacagttcacaatagggtttgcgctcctgtgagagtctgaggccgctggctgatctgacaggaggcagagctcaggcggtcatgcgagcaatggggagcagctgtacacacagatgaagcttcgctcgcgtgcccaccactcgccgcctgctctgtggctcagttcttaacaggccacagaccagtatcggtccgtggccggggggttggggacccctgccctagaacgatgctcggcacagctacactcggtgcacatttcttggtggcctgagcttgtcttgagctccatcaggatttctctgtcaatatttttgtagaccataccctgtcaccataaatggtgcttggtagaaatgactgtatgcatgtgatagggataacacagaaaacccatggtagagagcatggcgactaacttggagggacttctttttgtctttttttttttttttttttttttcgtttttgcagagatgcaggtattgtcatgttgcctgggctggtctcaaactcctgggttcaagcaatcctcccacctgtgcctccctaagtgttgggattacaggcatgagccgctgcctccccgcagcatggggggacttcttataagcatttttatttatttatttggaattcggatggatagatcatgttggcctgataatgtatgtgcaagagcacagactctggggtctcatggacaagccccactctgccccttgcttaatgtctctgagcctcagtttcctcatctgtaacaagggcagaaatgccatccgtgtgcagcagagtaccgacgaaagg

SEQ ID NO: 139623 - DNA, 1066 bp, Homo sapiens
gggacaataatcactctcaccagaaaagtagtttaaatcagaggtgtctctttacagcctcagagattttcaggatgtttctcagttcatttctgtgtcttttgacaatggatacaatccaggcgggccacttcaattttattggagtgaattctggagccaaagaagtgaaacttgctataacccagccaggtttattttactgtgcaagtagaattgagtgcaggaggaacgtgtccaaacttctaagccttgttcgttgttcagtttaatcctgaacaacatgctgcaatatctggatagagtatttgctggttttgagttaaaactctggtatgatgccttgcctgacagcctaagttccagcttggagactgtgtctatctggttcactgttacatctccagctcctagcacataaatatgtgatgagtacattctggtgattaggtttgctataaactacaatactagtcttgttcctcaagagtagtgttttaaacctaggtctatgatatcatgaaatcacatgtacaattcattcattcaacaagtatttactgagcaactatcctgtgccaggcactactaggcccagaggataaaacagtgatcaagacagacaaagtctctactgtccgggagctcacattctagtgctggaggcagagaatgactgtggctggccacttcaatatggatgatcagagagggtctctctgagagatgacaattaagttcaggtgtcaataacaggaagcagagatctgcatggcagccatgcaaggatctgtgtgacagagtattccatggagaaggaacaagtaaggcaaagcccccaagatggagaggagattctacatgttcaggaacagcaaaaagaccagtgtggaagagcaagagagtggctgagatgtgaagtgggagagacaggcagagccagttcatgtgggacgttctaggctatgtgaaagagtttgggttttgttattaatttattgggaagcctttggagggtgctaaccaagggaacaacatgatctgatttatgattttaaaatgttat

SEQ ID NO: 139624 - DNA, 1598 bp, Homo sapiens
ctttcaacctctccgagcttcaacatgttcacttatgcatcaggactgatccaacagcaacctgaaagggtcggtgtgagaaagcaaagaaagaggtactgtttacggagcgttcagccgtgagcccaggcgcaggcgcggagctaaacccggaggtgaagcaactacagctggggccacgcccacagactccgggctgtcggggcgggcggcactcgcgcttccagcctgggccaaccaggctgcttgaggctcgaagcgcatgcgcggtctcgccctccgtactggccgagccagcaaatcgcattgcgcagacgaccagcgggcgcctcggattccgcccccgggatggccccgcctcctcccgccccgcggcaaggcacgcacagggcagtgcgcgggtgggtgggtcctagcagcgcggcctgacgggaccaaggcggcgggagtctgcggtcgttccctcggctgtggaccgggcggcacgcacgcggtgcagggtaacatggcggatgcggaaggtaagggctgcaggcttccgggccgtgctaactccgggcgactcggggaacgggggtggggggatggtatcggggcccgcgcacgcctccctctggttcccgccggcgtgtcggcctcttcaccgcccggccttaagccggccttgtctctcggccctggctccgtggcaagggcgcgagagtgggagcccctcgcggtgacttggcatgatggggctcggccctctcacctccctggggtccgggtcgccgtcgaaagacatctgccgtgctgcccaccccgcggtggcgtgggacgtggcagtgtctgtgctgctgccagcccggacgccgccgttacagctccatgcgactaggggagcaagggtagtggaaacgggccgagaagaaaaggagcggagggaccccggagcagggatagagctccgagttgcaagaaagttctagaggccacaagcccgcggggacagtcgagtggtcgcttatggaactttccggccccctgcgtgagcgcttctgtgggatgtttaagctctgccatagccacgtggtgaaccggaagggaagccgacacgtgcagtagcctacagtcagttacccagccatgggacccatacatttggccttacacaccttgttttctcgcttacctacggatatacgttctaagaaatgggtcgttaggcgatttcatcattgtgtgaacatcagagggctcttacacaaacctaggtggcataggctactacacacctaggctgtatatggtgtagcgtatggctcctaggcttcaaacctggacagcatggtattgtgcggaatgctgtaggcagttgggacacagcgtcgagagtttgtgtacttaaacatgtctaagcagaaaaaggacagtaaaaatatagcacagggccgggcgcggtggctcaggcctgtgatcccagcccaggctggcggatcacctgcggtcaggagttcaagaccagcctggccaacatggtgaaaccccgtctctactaaaaatacaaaaaatttaggtgggcgtggtggtatacgcctgtaatcccagctactcgggag

SEQ ID NO: 139625 - DNA, 5410 bp, Homo sapiens
tactggagactttataatctgtacacctaggctacactaaatttataaaaatatatttttcttcagaataaatcaaccttagcttactgtaactttataaactttttacttcgactgttgtaataatacttagcttaaaacaaacacattatttagctgtacgtaaatattttctctgcttatctccttatttataagttttctattttaaaattttttaatttttttcttaaaaaatttttttttgttaactaagacacaaacacagcacacacagtagccttgacctacacagggtcaggatcatcaagacatcactaggagataggaatttttcagctctgttataatcttatgggggccaccatcacatacgcagtctgtacttgcaaaacattatgtggcatgtgactgtaattgtagacctaaaatccatttcctacctgccctaatttcggtctttattttaaacccttgtttcatttattcttggggaaaattcccaaatcctgtgtttgtttttttagtaattattttgccaaagaaacataagaagaaaaaggagcggaagtcattgccagaagaagatgtagccgtgagtagtaatgtgtttgacttcactttgactaaaaagaaagtttacttaaataacaaactaaaggaaagaagtgtttttaaaggtttccaaggaatgggccagcattggtagtcattgtgtagattcgaaaaagcactgaaatgacacagccccagacagtccaagtgtccttcaggcatagcttactaaatggtgctggccttaccaactgctgtctctgaatttgtcttccttatgccacccacagacccgccatccccctttctctttaaatgtttggacccatcttagtgacatttcacttcccctctgtactcctggttcatttcttctctctctttcccttggaggtcccagtgaaaaggcataggaagccttgttttctgtttaaaaggcatacatttccatggcagtaatggaattgttcaaaatcgggtgggaagtttaataggttatatttctgtcctgtcgaaggaaatacaacacgctgaagaatttcttatcaaacctgaatccaaagttgctaagttggacacgtctcagtggccccttttgctaaaggtatgtggttaaaatcgtgcatcagatgaatgcctgcttttacgttatttccaagtgttaaacaattgattgagaatgcttactgctggcatccttgactttgggaagtgcccactgatacagtttaaagcaggattccttaaggtatctgaaatgagaaccaagtttttaaaaaattggcagtgcactcaacactgttgtagaacacatgtccccacaatgttaaattgctgagtttgtcaacagttctcagtttttgtacttagtccatcttgcagacctatgccagtttgtgggccacatagtggtactgactctttttttacatgtgctcacgacatggtattttgttttgtgttgtgtcgttgctttgtagaattttgataagctgaatgtaaggacaacacactatacacctcttgcatgtggttcaaatcctctgaagagagagattggggactatatcaggtaagtgttgggaggaggcactgtgcaaacttactttcttttgaaaatgctttcacatcagctattcaggaaggcagtggcatgccagaatagctttgtcttgaatatataacctgtacccgcagtgaattatttttctttttaacttttcagatttgttgtttcactggagcattaagagtgggtgatacattaattttttttttttccattccaggacaggtttcattaatcttgacaagccctctaacccctcttcccatgaggtggtagcctggattcgacggatacttcgggtggagaagacagggcacagtggtacgctggatcccaaggtgactggttgtttaatcgtgtgcatagaacgagccactcgcttggtgaagtcacaacagagtgcaggtatgtgggagagggagggaaggactggctagagtgaaaagctttctgtatttcccttctatgttttgtctgctggaaactatttcttcattaagaaaaaaaaaaatcctaaagcaaggatattgttttggtttctgtgtacgttctgtcccctgccagatcttggtggtccgcgctttttggaattccacatactaagcatgtattcatcaagctgactggatccatttgtccgggttcagctctcagcttgtcactccaggcttctcactctgtgctaccgcttctgcctaaagtatccttcgttcatttttatctgagaaaagcctgcttatcttgcaaggctttttccacgcagcttctacactgagtactcccaactgtccctgttagtacattgaattcccagtgagaaagtgtcttcattctttcccacatcatcaccatgaaatctctcttaatgcaaattttatagaaacacaaggtcaaactgccgcttttcctgctgtgcaaaatgggagtgactgagcatataagaaatatggaaaacagaaaactcagtggccacacctgactactcttttgtcatttttcaggcaaagagtatgtggggattgtccggctgcacaatgctattgaaggggggacccagctttctagggtaagtctgcaattgtagggaggacaccctttgttgacttggatctctgagcccctaaacatctggagatgggttagctgtcctgactgactccttttgtccccttttcagtcggctgctgcagccagcctggaccagtgactgcacatgtacattctgatgaggtgtttgttttcatttgtgtttgttcttaggccctagaaactctgacaggtgccttattccagcgacccccacttattgctgcagtaaagaggcagctccgagtgaggaccatctacgagagcaaaatgattgaatacgatcctgaaagaagattaggtgagtcattaggcctgtgagtgggtatgaacacattcttcaggattctgttctcttattaaaagtagatgcccttgaagttgaagactttctaaaacctgccctacagctgggatattgtctgtgggcgatagtttttgttatcttttgttgaaaaagtgaacagtgcctagtaaagtgagatggcttttacaccttttatgatgactgcttctgctggagttgaaatgttttcattctgcatttgtgtagttcggtgctttgttcaaaggtaagtgttttcaccaaagtatgttttgcatgtgttttttatttgttgcaattttgactgcttagaagtttctgttgtcagaagtaaatttaagacaatgccaattttcctcccatccatgaaacataccatgctgaatatacctgcaacttaagtgttaaaaattctgctaatatcagaattacagatctttttttttttttttttttttttttgagacggagtctcgctctgtcgcccaggctggagtgcggtggcatgatctcggctcactgcaaactctgtctcccgggttcacaccattttcctgcctcagcctcccaagtagctgggactataggcgcccgccatcatgcccggctaattttttgtacatttagtagagacggggtttcaccatgttagccaggatggtcttgatctcctgacgtcgtgatccacccgcctctgcctcccaaagtgctggaattacaggcgtgagccaccgtgcctggccagaattacagatctttacagcaaatgcttatattttaagaagtgtgtctgtcacctctagtcttggtggctcagatgaaggataactgcatttctcaaccagtgatgtatttacagtaggtgctgcttttcttttgtgtgtgtgtatcttaggaatcttttgggtgagttgtgaggctggcacctacattcggacattatgtgtgcaccttggtttgttattgggagttggtggtcagatgcaggagcttcggagggttcgttctggagtcatgagtgaaaaggtatgtgttacggggctagaagttttagagctggttcttaccatctgccagcctttgatggcactccacttgcttcatgtcgtgggaaagatgctttccaaagtgttgagttcagtccagggcagcttccctgttctgttaattaaactttgggacattaaaatgggctaagggagatgattgggtagaaagtattattctattcatttgcctcccagcctacaaaaatgcctgcttggggtctaatacttcaacggttaaagatgcctggaagagggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccacctgggcgacagagcgagactccgtctcaaaaaaaaaaaaaaaaaaaaaaaaaagatgcctggaagagccaggactgaagaggctgaagacataatgagcttggactagtaaacaagtgacattcagttttaggaagtttggggtctgatgggctgagatacaaataaactgaattattttcatacatggctgcttttcaggaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaagttccgggttaggagtttatatttggaaagaacgtactccaaagatgaggcttgctctttttattgttttccttgggttttattttatttttttcaagtccaaaccaagtatattaatttaaagtaaaagtttaatggtaggcatacttaaaaataaggcacattaggccaggcacagtggctgatgcctataatcctagcactttggcaggctgaggcaagaggatcacttgagtccaggaaggagtttgagaccagcttgagcccaggagatcaaggctgtgagctgtgtttttatgatgatcagagagttggccttttataaattaaaacattgtctttttctctaacttgagggataaaaatttctggatatttaaaatgtttgtagttggtaattatttatattcaaatcttgtatagatgttcacattttttgtatgtgtataggctgtaataaatactga

SEQ ID NO: 139626 - DNA, 1086 bp, Homo sapiens
actttttcatatgcctgtttgccatttatttgtcttcttttgagaagtgtctgttcaaatcttttgcctgttttttgatcagattattagattttttttcctatagtgctgagttccttatatattctggttattaatcccttgtcagatgggtagtttgcggatattttctcccattcttatgcatatggatatctagttttcccagcaccatttattgaagagactggtttttacccagtgtatgttcttggcacctttgtcaaaaatgagttaaatgtaggtgtgtgcatttgtttctgggttccttattctgttccattggtttatgtgcctgtttttatgccagtaccatactgttttggttactgtagctctatactataatttgaagtcaggtaatgtgattcctccaggtttgttctttttgcttaggatagctttggctattttgagtcttttgtggttccatgtaaagtaccagtgttttttaacttgtgaaagcttagctactgttggattgtctcttaagactttaaatgctctgcgcaccctcttagtgaatgaaccttagagctattcatttaatgggtctaatttgtaccagaagtaagcatgtcatcaggattccttagctctgtgagcaggcaaggcagccacggcttatggacagcagcagaaaaggaatccttaaaacttcaaaggttctgtggccccaaagggagtgtgcatgccgttcttatagacgtcttgagctgcaagcctgttatgtgtatcgttaggtgctttggttaggtgttttttaacttcagaagtttaacgtcatttcaaaggcctccttctcataatggagtatttcctccatatgcacatcctgagcaaaggtaaccccaattaaagtagtagctcagagttttaaaagttttaaagtggcatacaacagtagaattggggctcatcaattatcaattctttcacccttcaaataattcttttctttattcaatgcctgtagctattgcattaatgaccacagcggtcatctctacctgcgaccatggtatagtagccaagatcaagagagtg

SEQ ID NO: 139627 - DNA, 2213 bp, Homo sapiens
agcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagagtttttcttagtgcagaacaaaatgaaaagtctcccatgtctacttctctccacacagacacggcaaccatccgatttctcaatcttttccccacctttcccgcctttctattccacaaaaccgccattgccatcctggcccgttctcaatgagctgttgggcacacctcccagacggggtggcggccgggcagaggggctcctcacttcccagtaggggcggccgggcagaggcgcccctcacctcccggacggggcggctggccgggcgggggggctgacccccccccacctccctcccggatggggcggctcctgccaggttcttttgtttggcattgttgaatacttgggcagctcttggtgtgtttcaccaccacagccttgtattgtgctgggctctgggttgtcgatgagtggaaacaggccctgtcttgggccttagagatttcagtctaatgaggggaaacagttgggcattactcacgtaatcacacagtggaatggcgaatttcatgcacgttagtggctaccaaggagtgcagagaggtgtctgtcacctggagtgtccacagtggtcaaggagtctggtcaagggattgtctgttaagccacaccggtgtgaagagtgggttaggtgttggtgaagtgaagaggggaggggagagttcagggcattgggagcaagcagcatgtgcaaaggcaaaaaagtagagtggctgcggtggggacgttatgtctgcagaggctctcactaataagctttgtgatcttcaacaagtcctgtgtgtgttggagttagtgggcaaattctgaatgctctggagaggagtttgaggccctgctgagaatacaccagggaggaaccttgttctattctttgtagtcaccatgcccgcttccagcattgacaccattctaatgttgacaccttgatgttccaccaggcaagtcagaagaagctgatgatcaagcagggccttctggacaagcatgggaagcccacagacagcacacctgccacctggaagcaggagtatgttgactacaggtgagggcaggatgtttcagagccggggtgggtagagacggcacacttgctgccttgatgcaggagtatgtcaacaacaggtgaggatgggaaggtagagcccacttgccatctggacgcaggagtacatggacaacaggtgaggaacaggtgagcatggaggttgtagagcccaggggagggggagtcacttggtttggggcaaacttgctaaatgcaggaccacaggaaccagctcttcagctcccgtgagattttggctgcccaggccagttaggggtgtgggcctgcacggcagacagttatccctttctagtctggctcgtgggactctagagggagtcagtctgcaacagtaagtggtgagttcttctgtccagcgtcagtattttgatggtggctttagacttgccagataacactacataacatcagtactgccctggaaagccattcagtgaatttgacctattgctacctctttttcagtgagtctgccaaaaaagaggtggttgctgaagtggtaaaagccccgcaggtagttgccgaagcagcaaaaactgcgaaggtgagtggcatgctgtcctcagtttggaatgtgcttagggagataatcctaagaggcactggcattcgtcttactttgtgactgtccgcagtccagccatatacgctagcatcagaggtgcagcgcatacacaggtaatgctgcctcataccctggggtgcttgtttgggctctgcaggctcctctgatttgtattctctgtcctatctgctgggaggaggaatgtgggctcaggaatcagatgggcctcgactcctacctcagctatggcagcaacacagtgatggaatgggtggtggtgtgtgtgtcaattctggcccccgccctgggtcaaatggtaggacagatgtgttgaaatcagaggccatggctgttggacattcgaggccatacaaaattcagcagagagcagaattgcatcttaacctggcaccacccagtgttgaaag

SEQ ID NO: 139628 - DNA, 4336 bp, Homo sapiens
ctgcactcagaaaccgggggcggtactgagtatcctgcacaggctgtgtgggaggagcttctgacttgtcagatgtgaattcctgctttgcctgctttctgtgagaggtccttgcagtcatgagagaaacagctcctccgggcctttccaccccaagccccgtgctgctgctgtgctccttctcttgtgcctgcctcaaggcttcttggatttgggggatgagactgtcttcaaatcctcagtaaactaaggccctgtccgggtttgtagtcagaaaacgtcctgttagattcagttgggatctttcttggtgccttgctaccttttgactcactgaacctttcttgtccattattgcccaagatctaacacttaaccaattgctttcatctcagcggaagcgagagagtgagagtgaaagtgacgagactcctccagcagctcctcagttgatcaagaaggaaaagaagaagagtaagaaggacaagaaggccaaagctggtctggagagcggggccgagcctggagatggggtgtgtggaaacacgttcaggttccttgggctggcttagtccctgcgtggggaaagaattacccaggtggtaccagctttgttactcttcttggaggagctgtggcctgggggtgggatgccaccgagtgcctttagtgcttccccatgttcctggagtgcttttgccctccctgtggaatggacagatagaggcacccgacctctaccacttatacttagagctctattgatggtgggtggagaggatgtgtaggatggtgatctgaatgtttccacttccaaaagtagaccactagggtgtcactgaaaggtttacagaactttgtgtcacatgcagcatttaacccaaaatatccttacaggtcctgaaaaaggcttgcttgactgtggacctttaccagatttccttctgggagagtcatagctttgttagtggatggtatctgtgagctttcattctctttctttctaggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatcccctctgtttaaaaggtttgtaaaacaaaaacaaaaaactaagtctgctcagtgaaatgctgtagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgctgggagaagaatgttgtaatttttacttattaaagtcaacttgttaagttttttatgtattcctgttgggttttcttgttgatctcatgctagcagagcaaaaattgtaaaatattttgattaaaaatctagggacctttatgtcctatttgaaatgtgatgcttttatgtttgttttctggtttttacatttttgttctgtatcttacacaatccaccttgggccctgtcatctgatgtgagatcaagtactcagaggcagtgattaccacaaaaccactgatctctagaagaacagagaaggagagggttaatgtatttatacatagtgggcctggcaggagcggggggcagggtgagtcgggagaacgaagctgagggtggggacatgcaggaatctgaaggccttggtgacagattagtggaagaaaggtctagggttgcttccgatttggtattaagaaccaagaaagaggccgggtgcaatggctcacacctataatcccagtgctttgggaggctgaggcgggcagatcacccgaggtcaggagtctgagaccagcctgggccaacatggcaaaacccatctctactacaaatacaaaaattagccaggtgtggtggcgtgtgcctgtaatcccagctactcgggaggctgaggcaggagaatcccctggaacctgggaggtggaggttgcagtgagccgagatcctgccactgcactccagcctggcaaaacagactgtctcaaaaaaaaaaaaaaaaaaaaaaaaaaaaaagcgctcttggatgcagcgaggcgaggccctgagctgtagccatatcatgagccaggcatgcagggtgggccccagccctggctcagcgaccggcctccactgtaccacgggaccccaggcttggattttctctcgttctaaatatgtgcccacaatgagcgctccactagctacaacaaccttaagggtgtttttctacatgggcactagccagtagagccctgcagtgggggcagagaatggggactcttccagggcaccagtgtttatcatctgaacacaagagaggcatcttgtgttaatgctgttgtccaggagcttaagtgaaatgggccacatttctttttgtgtggaaacccagagttacaaggtcattggcatttcaacacagcatttttattgcttttgaaggtttccctagagcagacatcattctattgcacagatgtgtcattttggcattatagaaagttgcagttaaaaacgctttctccaaaataaaaagacaaatgaaatacccagcatatacagttgaaggcaaaggagggcaggctttagagggatggggtccattgcttttgctgtgcatcacccttgattagcagttacattttggtagtacttcttacccccaatttctagaaatccttttcaaatccagatcagtggggccccatctatcaggagaatcaacccttcaggagcctgagcaagaagactgaaccttactggctgaattaggatagctgcagagagctggaagctgacacaaaactagttggagcagccctgtttgtcttaaagcaaggcgggtggaattccaaatgctggagaggggcatacagtgggttcccccattctacaagcttagtaaacccaggagacaggcacccactgtggagaactgcacgcttggtcgaaggcttcttgtaatttcttaagggtttcatcaacaccattattgaccagtgagaggtcaaagtagtgagcgtactggctgcggatggcctcagagtccttctgcagctgctgcagggcttctgtctgcaaagaagaaagccacagatgaagcaagctgcaccacccccagcccagagaggccagtgacagattttaaacagcaattgttagcgttgctcagctgtgcatcatacttgacgagtcaaattcagaagacattgtgaaagaatgttaatgtagggcatgaagaggcaatctcaaaagaccatggcaattctcagaggatctcaagctaaccctgactaatcagagtcctctggaggaccaatagctatgcagagacagcatggacttcaccagcatctcccacttaatgccctttgaacatggaagagccatttcaacaaccaccagagctgcaatcctaaaacgaagataaaggtgattttgttgttttgttttgttttgagacagtgtcttgctctgtggcccaggctggagtgcagtggcacaatctcggctcactgcaacctccgcctcccgggttcaagcaattctcgtgtctcagcctcccgagtagctgggattacaggcatgcgccaccacatctggctaatttttgtatttttagtagagacagggttttgccatgttggccaggctggtctggaactttagacctcaggtgatccgcccgcctcggcctctcaaagtgctgggattacaggtgtgagccactgcacccagtcagataaaggtgacttctaatcccagatcacacctgtaatcccagcactttggaaggccaaggcaggatgattgcttgagcacaggagttcaagaccagcctggcaacac

SEQ ID NO: 139629 - DNA, 1033 bp, Homo sapiens
tcactggtcaataatggtgttgatgaaacccttaagaaattacaagaagccttcgaccaagcgtgcagttctccacagtgggtgcctgtctcctgggtttactaagcttgtagaatgggggaacccactgtatgcccctctccagcatttggaattccacccgccttgctttaagacaaacagggctgctccaactagttttgtgtcagcttccagctctctgcagctatcctaattcagccagtaaggttcagtcttcttgctcaggctcctgaagggttgattctcctgatagatggggccccactgatctggatttgaaaaggatttctagaaattgggggtaagaagtactaccaaaatgtaactgctaatcaagggtgatgcacagcaaaagcaatggaccccatccctctaaagcctgccctcctttgccttcaactgtatatgctgggtatttcatttgtctttttattttggagaaagcgtttttaactgcaactttctataatgccaaaatgacacatctgtgcaatagaatgatgtctgctctagggaaaccttcaaaagcaataaaaatgctgtgttgaaatgccaatgaccttgtaactctgggtttccacacaaaaagaaatgtggcccatttcacttaagctcctggacaacagcattaacacaagatgcctctcttgtgttcagatgataaacactggtgccctggaagagtccccattctctgcccccactgcagggctctactggctagtgcccatgtagaaaaacacccttaaggttgttgtagctagtggagcgctcattgtgggcacatatttagaacgagagaaaatccaagcctggggtcccgtggtacagtggaggccggtcgctgagccagggctggggcccaccctgcatgcctggctcatgatatggctacagctcagggcctcgcctcgctgcatccaagagcgcttttttttttttttttttttttttttttttgagacagtctgttttgccaggctggagtgca

SEQ ID NO: 139630 - DNA, 1448 bp, Homo sapiens
agactggcaaaaaaagaaaattttgacaacatgctgcaggcaaagagaaacaagcagtctcacaggtggttggcggtccctgtccaaattctaagtgtgtgtgctcttggacccagtgatcctacttggagtttttcctacagatatatttgcacacatgtgctatatgcacagggctattgactgcagtattacacatgcatgcagcagaagaccaagcagctatagagaaaaagagttcctcacaccctgatagggaaaggtgtccattgttcaatgcaaaagcacagtgcagcaaagtgcatgggtagggctgggcagaggagcagggtaggctttttgatatattcctggcctctctgtctttccccacagccatactgcaccccagggcgggttcagtgccacctctgtccatcacagcttcccctgccagagcctgcatcccaccagtatcaggatctgctcaactgtccatctctgcccctggaactgtgtgcctccaggacgatgactgggtctggtttgttttgtccctgttaggtagcatgggcactggcctagctagtggcttaagagctggaacgaatgtgcataccctttggcttcttggccctggaggaagaagcccagctggagctgtgacctccagccagcactctggccaatgacctggactgaggtcccagtatgggcaggcccggagaaagtgaactacccatcgcgcacaacctctcctcacctgagtgccctggtcagtaggtgcaatgaacacaatgaaaggcgaaagttctgctgtccgaacaattttcagggtctagaaaaaaaaaagaagggcggcggggaggggggggaaggaagaaaaggaaagtgaaaaaaaaaaacctacatagctgtcataatggattccttctaataagcagctttgagctttaccccaatacaactttccatcattcccagtactactgttcttgttccaggctgaccccattaaaaggctgaagcaatcctgagcccccagaagattcccaaggagcactgtcttcgccatcccttgtgtggctgagcccatctgtccctgcccttccatgcctacccacctggggctcaatgtcaaggatggcaatcttgttctgcttatggatctggtgcactgtttcaaatttggtgccaaacatgttgccttggtagctgccaaactccaagaactcattggcagagatgttcctcgtcatctcctccgttgagataaagtggtactccttcccatcttcctcactcttccttggcggccgtgttgtatctgtgtacaagaacccaaatccccgacaaactccaggtcctcaccctttcatgagggcttggaccatggtgtctgtatggaaaccctagctgcctttggtgcattgactttaatacaggggttcctcccgtgggctcctgaa

SEQ ID NO: 139631 - DNA, 1050 bp, Homo sapiens
caagaaatcctgaccatagtctgtagatctgtttttaaaatattttccgctatcttcatttctaagtttcaatattcctagatttggtagtttgagagatgtaacttcatttagggaaaatgataataggaattttctatgttaggctttgccccttaaaaattaaatgtgtcctgggcagatggagggatttcctggtgtgcatcactttctagcatcagctcttcaggagcccacgggaggaacccctgtattaaagtcaatgcaccaaaggcagctagggtttccatacagacaccatggtccaagccctcatgaaagggtgaggacctggagtttgtcggggatttgggttcttgtacacagatacaacacggccgccaaggaagagtgaggaagatgggaaggagtaccactttatctcaacggaggagatgacgaggaacatctctgccaatgagttcttggagtttggcagctaccaaggcaacatgtttggcaccaaatttgaaacagtgcaccagatccataagcagaacaagattgccatccttgacattgagccccaggtgggtaggcatggaagggcagggacagatgggctcagccacacaagggatggcgaagacagtgctccttgggaatcttctgggggctcaggattgcttcagccttttaatggggtcagcctggaacaagaacagtagtactgggaatgatggaaagttgtattggggtaaagctcaaagctgcttattagaaggaatccattatgacagctatgtaggtttttttttttcactttccttttcttccttcccccccctccccgccgcccttcttttttttttctagaccctgaaaattgttcggacagcagaactttcgcctttcattgtgttcattgcacctactgaccagggcactcaggtgaggagaggttgtgcgcgatgggtagttcactttctccgggcctgcccatactgggacctcagtccaggtcattggccagagtgctggctggaggtcacagctccagctgggcttctt

SEQ ID NO: 139632 - DNA, 1050 bp, Homo sapiens
ataccaatatttttctagtaagttaatatttgagcaattgccacatgccacccattgcattagacttggaaaggacagcagtaccacttggtagcattttggggtttgagctaaacaacaaagaaacatggagcttgctggtgaaagaggagtactgagttctttgccttgctttgttattctttttagtgtatacatctgtgtcatagtctggagtcagtagccactctagttccaggaatttgaggacaaggtgttttattgtgctgttggactactgaggccaaggaggatgagaccatcttaaactgtcaagtcaaatgttttcaatcctgagtatttgacacaatctgtttcataacatgctgtaaatcctggtttctcttctatggtatcttgagttacattgacagctcctgtttgaacttttgttcttttgtggattgatttttcatttcatggcaggctcccttcacgtgggggatgagatcctagaaatcaatggcacaaatgtgacaaatcattcagtggatcagctgcagaaggcgatggtgggtattttctatgctagatgaagaccttccattgtctccataagtgttgatccacattggtatcagtgacctcatctctctgtcaaagtatttgtaccttcttgagggggctcttttcactgctagtctttaatctgtgtaagaaatgataattttctgcctttatttagtaaaattctaaagcagggcaaataacccagagcatcaatctggtgttccatgaagtaatgccaaatgaagtaaagcaagctataacgtatatagtagaatcccatttttgttaaaaacaaacaatacatatgtatgcataatgtatgtaaatatttgtaatgcttttgttggtatggggaaaggcgtggatatatatgcgccatagttcatttttaggaacttcttcaggactttttggggtaaagaatggggaagaaaagtcttttttttttttttttgagatggagtttcgctctgtcacccaggctggagtacaatggcgtga

SEQ ID NO: 139633 - DNA, 1018 bp, Homo sapiens
gatgctaacctgaattacctttattgctgtgtgaccgagagcatcaggttgttcaaggaaatacaaaggagaagagaacatgccagaaacccttggagcctgaggtgccgcaggattcagaatctttctaattttgttatatattatgtaataccccaagcaggatccaggagagcaccatgtaaatcaaggcacattaatatttctgcagcaacctagataaacatgtctattttatttatttttagagacagggtctcactctgttgccctgggactgtagctgggactacaggtgcacaccaccacacttggctgacatgtctattaagttggagaaataaagcttacaaacagcttcatgtcaattcaaataagaatgaggccaaacttatgaaataagttttcagagcctcttgaatgttagaattgcagattgtggactggctgtgggccttgctcctgatttcatacgttgctttgttgttttggcttggcaggctgtatcgcatccattgaatactgtgaccgaggacatgtacaccaacgggtctcctgccccaggtagccctgcccaggtcaagggacaggaggtgcggaaagtgcgactcatacagtttgagaaggtcacagaagagcccatggtaatcccccgtcatattgtcgcccaccagttactctctgccccatgagtcactgggccagaagagtcaatgcaagaggctgctcatggagttagggaattggccaaccccaaaattgtcttttcattcttatctcaaattcctcctcaaagcaggcttcatgcctgttctagttgaggactatcctgggtataaatggaaaatattttcctgagaaattaccgtaagttctttctaaaataacctcagaaagagcttaaaataaagcttattgtgccgtcgcctttatttcagggaatcacgctgaagctgaatgaaaaacagtcctgtacggtggccagaattcttcatggtggcatgatccatagacaagg

SEQ ID NO: 139634 - DNA, 1150 bp, Homo sapiens
cagcactttgggaggccgaggcaggcggatcacctgagatcaggagttcgagaccagcccggccaacatggcgaaaacctgtctctatcaaaaatacaaaaattagccaggcgtgttggcaggcgcctgtaatcccagctagctgggagactgaggcaggagaatcgcttgaacctaggaggcagaggttgcagtgagccaagaccacacccctacactccagcctgggtgacagagcaaaactctgtctcaaaaaaaaaaaaaaaaaaaaaaaaaaaacaaaaaacagaaaaaagtcatgaagttcctggaagtgaaggacaggaaaggcagactggctgagaccacaccacatactggggaaattgggcagaggactaaataatttgaaaattacactttactttctagtatcagttctgtgaaaagaaaagccttgaacggaaccatttcctttgcaaaggaaacagcaagatccaagtctgcagcgaaagttctttctcaggtgaaattataactagtcagaagcagagtcagtgatcatgcacaccgtagactcaacctcctgccatcgcagaaggtgccgcactcggcatgcaccttggtgtccgtgcacaggctgttccctctgcccaggtaccacctgccagttacagcctaggtactgcgaaatgcaagagcccactgtgctgggtgcccctccttgctccacagcgctccacagctgcttctatcacatcaccaccacactactgtatttgtttccatgtctgcgtccttccttatttgcctcttagttccagcagcagacctggagtaggcaacaaacaacactgcgtcacactcagtgaccaccagcggggagtaatgctgcatgtgatggcctaagaaccaagaaacaggttttcttggtggaaatttgcctggagcctgacttatctgttaggtgatttttttttgatgtgggataggcccaagagaattttcagggattctcaaccaattgcttcaggtcctggggaaagtgttgcttcaaacaggcccgaagagaaaagcagtattgggaattttacaactacttttatgtgcattaatggatactgctgtgaagaacaaggccagagagagctaataaaattagtttctccat

SEQ ID NO: 139635 - DNA, 1010 bp, Homo sapiens
tccccacgaatttggccagggcacccgggcggctcaggcccaacggggcgtgggccgtgtgctcaaccacccagaagctgggggccccctcccctttcttatctttctggcattcatctcacgcggccacctacagctacgacttcctcaggccctttaagggccgcttctcggagcgcagggagccgcggagtccggggcgtgggagacttccatgggcggagcgagggcaggagtgggcgggccgtaggcggagctccgtccgcgccctcccggcgcaccgcctgcggggcggtgactggcccagccgcaccgcgtctcccgccttctccgcagccccgcaggccccgggccctgtcattcccagcgctgccctgtcttgcgttccagtgttccagcttctgcgagatgaccctcaaggcgagcgagggcgagagtgggggcagcatgcacacggcgctctccgacctctacctggagcatttgctgcagaagcgtagtcggccagaggtgagcgggccccgctagtcccaagggcgctgggccggggctcggccattcatctcgggactttccctgtcccggtccctgtccccggggggcctgtccttgcgggtcctggccataggtcggagaccgcgatagccggcggggtgaggacaaggccagcgcgcggccgggttcgtaccgggctgctggtgcagtggatccttgcccccagcagtccttccagttggaaatcaggagaggcagcggcctggacagtgcgcttattaagggcaaggaaaacttcctcgtggacggaagtcagagtaacagaaagtctttaaggaacacatcaaggagtaggtctgcctggttgttgttgaagtgcttgtgtttgggtcagcagaaatgattgtaaaagccagcttctggttctaaagagctcactcactgttcctcttcatttaggcaggtccccttgtgctatggtgcaaagagggtggccagtgtatatttgcgggtgg

SEQ ID NO: 139636 - DNA, 1063 bp, Homo sapiens
atatatacacatgtgtatgtatgcaatgggctgaattgtgttcccccatcccaaatttataccttgcagtcctaaaccccagtacctcagcatgtgactatacctggagatagtgtttttaaataggtagttagttaaaataaggtcattacggtgggccctagcccaacaatactggtatctttattagaagaggagattaggacaaagatatataaaggagaaaccatgtgaagacaagggagaaagccatctacaagacaaggagagaagcctcagaagaaaccaacgttgcccacatcctgatctcaagcctccagagttgtaagacaatagatatctgctggttaagccacccagtctgcagtactttgttatggcagcactagaagactaatacaatgtatgtatgtgtttatatatgattatataattatagagaaaatatgtcttaaaatatgttacctgggcatggaatggttggtgaaaagatgtaatatagaaggagatagggaattaaaagggagagggaaatcaagtaaatattgaaaggaaaaaatggtgactggatttttaaaatatgggttatatgatcacgtgtgtttgagtaaaaattatacatttataggtaacataattgttaaatttatgtgcacatacaattcattcattatctggacatcactttgattacatcaatttttctttattcaccacccactggacttaagtgctgctttactcactgtgcatgatgttggaggcttggaactctggatcctcaagctgcactccagctggattggggagaaagcgttgtatattctctgtgaggtaccagcttcggttctcatcaaatacagaaaacaggatgacattcctcttgtctgacattatctgttaattacatatattgaaaggggtaaagaaatgctactgatgttgtcaggtaggagctagcagtctatgatgaaagcgatggcatgcatgtgatatatctaatccattggtttaattccatttcctcttaggcatgtaccagggcttgggagttgagggtggg

SEQ ID NO: 139637 - DNA, 1032 bp, Homo sapiens
taaaaaatgccacattcaggacagaatcttgtgccttatcccttgcaaccatcctgtcctcaaactcaggagtgtttttttttttcttcacaaacagttcctcaggtctgctccctccttgccatctctacctcggcccattggcattcacttctcttctggatcgctacctcaccgtcttaactagagtctctgccttcgtcctccccctttaatctcttctccacaatgtagccagagtcatcttttaaaaatataacctgagagttttaagggacttactcaagaccacaagattcatagagccaagatttgatttccttatgtcatgctcctcttggggctggctttatgtagggggtaggaaggagctaggtcatcttaagctaagtaagatatgaacattgccagaaatgcatgtttgtatgtaactgacagctcatcaatttgtctgatgttggtttgtttttgtaggtgcacaggtttcatattccagaaggttggaaagttggctgcaacagctgtgggaggtggattttttctccttcaggtctgtatgtgaaatgttctcagatgtttggaaattccacctgcccattaaggaatgtggtgtggggagttgtaatacagtcctggctatgtcacactagactagccttagcacttgttttcatgtactattttaaatgctagtgaccgtttgagtcaaattttattcattatactagtaaatgttatttgccagtcccattttatttcctcatgtggcgacagaagtgcaaattccttatcatagctcccttaaaagagtttttaagaccagctgaattattaagcggatgtgatttcaaaaatacaagtgtgctgtgatgatttagtgtcatatgctaatattatagctagctttcacagaggggatgttgagcatgtgatgagaaatgggagctaagtgacagtacagtcagatgtcgtctgctgtctccttgacccatagtttcagaaccagtggttgccagttctctgagactgctt

SEQ ID NO: 139638 - DNA, 1215 bp, Homo sapiens
tgggagcaggtttcaggggggaatgcatggatggagagatttaggggagagacttcaggaaatgagaagcctctattggagggtagatgccaaagaggatggaaggagcaaaattggaaacagaattgcctctgtaaccagtttatttagtgcagctttactctttcgccataactgtccccatgaactctccttctttgtccttgattcaaagagccattgtctctacctcctgatgtgcatcctccttcccatcaggctccctctagtcttattctccccacaccagccagtagtcattttcatatgtaagtctatttaattattattaaatagactattagtgtaagtccattgccctttgggtaaagtgcaaattacgtaaccgatgaggggattgacattgttaagactggcataggtataatagagatgattcttaatattattaacatccttagcaaaacaacccattgtactatcttctgttttcaggtggtgtcatttgtgaagaagaatgttctagtaactgggggatttttcggaggctttctgcttggcatggcatcctaaggaagatgacctcatgttcattgttcctggttttttccagccagcagcctctacactccatcataggacatcgagtccctcctcctcttctcccatgccttcttccctgccatggcaaatctgagtggcttctctaagcatctgctggtacaagtcaatgtggcaccatgagcttcatggtggcagaagagacaatagtccttagctctcctcccagtacaccccctacttggccagtctgtaggccaacaagaaggttcctttacccccatgcaagacacttatgagaacacattacaagatggctgaccgtggaggatgagtggatcctgaaaggttgtcccaaactgttgatttggaaaagaaataagcacatagataaccttattgtgtgctgcatggaaaggaactgaatacatttgcctttaagcatgaaagattttggtatcttggtgtctactttcttttttagttggttttacattacagaaagctatttaaatgtgttataattatgccgacaaaattggcagcataattactgtaattgaaaaatctgatattgtccaggaatgctttctaccgtacaggataatgtatctcatggctgtttccaaagggtttatttattgtaaaacaagt

SEQ ID NO: 139639 - DNA, 1109 bp, Homo sapiens
aatgtcattttatcatatttcagtatgtatctctaaaaggtaagaattatttctaaaaatcataaatacctcatcatatcagacattaacagtaattacataatatccaaaatctgatcagtgttcaaaatttcctcaagtgttttatatttagtttgtttgaatcaaaattcatgcaaggttcacatcgtatttgcatgatttggataagtctcttaaccttatagatcctcctctatttttttttttttgcttgctatatatttatatctctatatatattgatatagacatatgtagtgacactgagtcatctgtttcctgcttccccacactctgcctctcctgacatctgggtctctgggttatgccatatatggtgatagtggctgcagccactttacctgtgtgacttacccacagcaatgggatggtaacagcaaagctaaccaaagtgctctgtgcccctttgggttgcatgtggggagactggccacccaatgcctctccagtggggtaggggttgtcttttggtgcatctgtttttcctgtgattattggtgagggcagcaaagattagcaggtggttgtaaactaccttgagtaggttgtaataaatagtctggcctcagactgtattctgattgtctgaattaagatctgtaggtaggtccctcctgaagttttttcccagctggctgcctctacgactgtgagggtcatggttgaggtcagtattgcaggttggcctcatcctgctagtatgagaacggctgtgagttctgcccacggtgtgaggccactgtgaccacttgggattgtgcagagctggcatggaggttgaacacgcacagctgcacaccttgttttcagtttagctgaaccatcggtgaaggaggctcaggcatttggggttacctgtgaatcaaggccctattgtgccagcagttttgtttcaggtggtgaagtgggagttaaggtttcccccaaaagaacagctgccactcctccatgcaaaaccgagatgattcaaggaccaggcagctccacctttcagtgcactactttcatttgactggagaggcctgcttagctaggcacgtattttc

SEQ ID NO: 139640 - DNA, 1024 bp, Homo sapiens
agctgtaaaaaccggctgaatttgaccctaaggctgcagtttgccaattcctgatgcacagccttagtaggggaggtccaacaatcagcttaaactgtatgcaaaataatgtgtggtgtatgtgcattttcctaattcatcaaattagtgaccagtaataaaaatgatgttaaaaaccaatgtcctagaaaaaggtgcatacatgctattaaccttaaaggaaattatatattaaaatagctttcaaccactttgtaaatcatactttccctaacgaacctgtcgacaggtctctaaattagaaagaattcagtggactttggtatatcttctttcttccagttccataggtactgaaagtgaaaaggggtgggaagcactgatctaaacctccctgtaccttagtcctatgagatcatgactagagtctgcctgtatgtttttcagccaacagctacatggaatcaaagtgtcaggctgtcatccaagaactgcgtaagtgttgtgctcagtatcccaagggaagatctgtcgtctgttcaggatttgaaaaagaagaggaagaaaacctaacacggaagtctgcatcaaagtaaagttcttctgaagtgctgctccatgtttccaccaaatgaattttttttatcctcctgactcttcaggccaggtagcagcaaatagcaaatgaaaaagtcagctacaaaagttaatgaatatgccatctatgcagaacaggcagaaatataaacacattaaaagacaaatatgtagaatgtaatatactgagctgctaaaataaacctgtttaagagaaaaatttgggttttgtactaaatgtattttaagactattagatatagggtattaatgaattctcttgaagttcaagccactagtgccattcatcaaatttaagtcatatgaggtatgttaggtgaaaggactcacttccagcatcacaattttgacgcccttttttttttttttttttttttttttgagatggagtctcactctgtcatcc

SEQ ID NO: 139641 - DNA, 1049 bp, Homo sapiens
ttcatccactactgcagtgcacccacccttgggcctggggggagggagtgggttgaaaaactgctcaagaaacagaagtttagcaagggtcatgaagaatactgcaagtgaaactgcagagagaggttacgtaggcagaaagcaagtcaacaaaagcacttagtcaggatccgtaacttgaaattgactcctttggaaattgccatagaacccttaatggacatcatcggctggacctgggatctgatgaatcccacaaaagtcagcaccttctacagaacagatgccctgatcaccaaggacttggtactgatttagagagaagagagcagctcctagcagcatcaacatctatttgtcgcttatttgccctgcagcaattcacctgcctttccttctcccatcctgtaaatatcctaggttttgctccagtgtttcccatcccagtactgacctaatttggatctgctgagtatttagagggctctgaaaagagatatgcattgatgaaattagctacaaaggcttgtgggcctttttttctatctgaaatcgtgtcttcaaattactggaagttgctgatcaaaattgtgggctcttgaattcattctctgattacagatattttaaataagctggtttctataagaacttcaagaaaaaccattttagctgcttaactggcacctttctcaggaagtaataacaccaaatattgctgattcctaggaaaacatttactacttgtaaagaatttcctgagttaaagtagttataacagtttatatacattaaaagtaaggttttactttaaaaaaaaaagtcttgggaataatagctaccatgtattggagtcctttccaggcactattgtatgtactttatatactttatcacatttaatcctcctgtcaatgctttgaggtaggtatgattcccattttatatatgagtaataaaaaaagctcaaggagtttaatcatttatcaagggtttcttctgcgaatgatagagccaggctgcgccgtcggctcctctagcctaacgtt

SEQ ID NO: 139642 - DNA, 1347 bp, Homo sapiens
atttaaacctagtcctctatggaaaaatgggctcctgtaacatcctgcagaattattaaaataaaacaaggacctagatggataactttcatttgcactcactcagctccaaatcagcatgatccccaaagtctcttgcagctcagaaattccatgaagctagcttacttttcctaacaagaaaatccccttctagaaatgcccatccgctatttgtaaactttcttagtaaactgataaatagatcatttgcccttaaaacaaacttttaatttcaactctgaaagacatgcatatatgtccttcagaatcttaccttttaaaatggaaactgcttggaagtggcttttacctggggaatatgacatgcatgtgtctgttatactgccttcctgccaaaataagtgtgtctttaggcacgctctttgcatattctattgctaactacattttgccagacactgcttgtgaatgcagtatgtgtgagaccactgcccagcttcctgtagtgctagtcctacatttccacagaactcctcacctagccaaattcttgagcgctttgcagtcagcagcactacctgaggctctgcctgagtgtcactttagttgtcttgcagaaagcttcagatgtccttggttctatttaggttgtgcaaatagacatatgaggtttggttctggttagtggttgctagtaccagatcaccttgcttactggtgagttcattcaaacccaaaaagtcacacctgtgtcctgtgcgcgggtgctgcaggcttaggtggagaaaagcagggctagaattggaacccaaagcccagaatggcaggagaggatgtgggggctccacccgatcacctctgggttcaccaagagggtatctaccgcgacgaataccagcgcacgtgggtggccgtcgtggaagaggtaactgtttacattttgcttatttctttgattttgctttcaagtaacttggtttctattccagtctcaatattctgaagtctttggttttatttttgatcattcctttccattaggagacgagtttcctaagggcacgagtccagcaaattcaggttcccttaggtgacgcagctaggccaagtcaccttcttacctcccagctacctctcatgtggcaactctacccggaggagcgctacatggataacaactctcgcttgtggcagatacagcatcatttaatggtacacatgttgcttaattattttccattgtactgggactctcgtaacagagtactccataaacttttctttttctgacaggtcaggggagtacaggagctgttgcttaagcttttgcctgatgactaacct

SEQ ID NO: 139643 - DNA, 1022 bp, Homo sapiens
ctcccctatgcacagccccattacttcctccttctctgtgctcagagcgtggttgagacaaacgaggaaagcgtcagactcgagatgaaccgcctgcaccgcctgcaccacctgcaccgccatcttggcccgacccttctcacgtccgcctcgggcccacttggtcctgaccaaccgggtgctgcggcgcagcctccccagcgcccagcgctgtgcgctccgcccaggcctggccttcggcgcgcgggttcctagggggcggggcttagggagcgggcggggctgtgggggcggggctgtgggggcgaggagggggcagcgggcgcgcggctggcgcgcgggggcgggccttggggcacgggggcggggcccgcccagcagcacctgggaaacgcccgcgcggtttggggcaggcgtggccgtcggggcggagggcggtggccggccgcggtccgggcgtcaggccgggcggcgggggcggcagggaggcggcgctctggggccgcaggcggacgtactctgtgagcggcgcccgggcgcctgggcaggcgcctcccgagtaccggcgcccattttgcccgcccgctaaggagacccgtgcgcggcctacacgcttgggggacagccctttaagacgacatctccgcgaacgccggcctcttgagccagggggacgctcttttgaaagtcagtcccaaaacagttaaggttttattttattttgttttatttccaagtcacagcccccgaatctcgtacaactctccctggaccacttccggttgccggcccgcgcctcataacttcggttcgagtgacctcggcccgggatgcccctcggctcaccccgggctcacgtcgcgatcctggcttgagtggcccagggtgggagacctggaagttttagcctagctgttctcaaggcggattaattagcccaagaaacattatattcatgtgagtaaccttttgcagaaacagtgttatactgtatctgaaaaagtatcactcttaagcttggc

SEQ ID NO: 139644 - DNA, 1180 bp, Homo sapiens
ggcgttcgcggagatgtcgtcttaaagggctgtcccccaagcgtgtaggccgcgcacgggtctccttagcgggcgggcaaaatgggcgccggtactcgggaggcgcctgcccaggcgcccgggcgccgctcacagagtacgtccgcctgcggccccagagcgccgcctccctgccgcccccgccgcccggcctgacgcccggaccgcggccggccaccgccctccgccccgacggccacgcctgccccaaaccgcgcgggcgtttcccaggtgctgctgggcgggccccgcccccgtgccccaaggcccgcccccgcgcgccagccgcgcgcccgctgccccctcctcgcccccacagccccgcccccacagccccgcccgctccctaagccccgccccctaggaacccgcgcgccgaaggccaggcctgggcggagcgcacagcgctgggcgctggggaggctgcgccgcagcacccggttggtcaggaccaagtgggcccgaggcggacgtgagaagggtcgggccaagatggcggtgcaggtggtgcaggcggtgcaggcggttcatctcgagtctgacgctttcctcgtttgtctcaaccacgctctgagcacagagaaggaggaagtaatggggctgtgcataggggaggtgagtaggtctgttagcctggatggaaccctgctgagcagtcccagtgtgtccccggggtgggtgccggcagctcccagggctgcggaggccacaggcatcctcgatttaggtccttggacaccctttacatagctctgtcgcggggagccccgtttcttctggccgcctgacacttgtttagtctcctgcgagcccccggcggtctgtacaggccccgggagccttgccctttctcctgtagcctggggcttctctttagatctgcgcttttcgcccggttgaccaaaactgcaaggcaggtcagaaagacactggagtataatgaggatgtccgggtattacgacgcagcagctgaccacagttagagccccttgcctcgcctcgagtcttctgtctagggagcagagatatcaaccaaagcatttgaagggtatcgaagagcctaacagaaggtgcggggcttgaaggaagcaaaagtttccgctgcattgtgttgaggaggggccgaagaggatgaggaaa

SEQ ID NO: 139645 - DNA, 1047 bp, Homo sapiens
caatttgagatgaaatttgggtggggacacagagcccagccatatcagctcctatggcattgacttactacattatcttagtggagtttcatgaatgacaacttgccactcaaccatgtcgttagcacattgaaccctttgtcagtgctctgatttatattcctttgtgcaatacagtgttttgtacatagttgtaagtcaaataattactagttgatcatcctaaaagtccttccttgatttaaatattagcatatatattttatatttttgtgtctgaaatgtatatattgaggttgggtgtcttttatttgaaacatttcattattcgtgagaaaagtgtcagttttctaaaatggaatattttatctgatattataataaaatgcaattctatagttgaagggggatgtgttattggagagagctgtaagtaaccatttctgtggattttcctttaggttgatgccgtcagaattgttcacattcattctgtcatcatcttacgacgttctgataagaggaaggaccgagtagaaatttctccagagcagctgtctgcagcttcaacagaggcagagatatccttactggtcaatagaagcttttatgtgctctggggttcctgggccgcattgctgcttgctgcagtcatcctgctttaggtggtttcacaagttttcttcccttagatccaattgtttggtttttagaatttctctctatttctccttttgagtggcttttattggaagaattagaaattttctgacattcctgctcctaaatgccaaaagatctcagggtcaaacactgcgacaatgaactctgtgtggagtcccctccatcttcctccctagtcttctctccattcctccctgcccctccttccagttttcctagtatcatttaatttctaggccatttactatcttggtctctatcctcttgagagattctcttttgtgacttcctctcaaaaaatgcaatgctgggaactgaatgcagtgtttcatgttacatataaccccaaaatgatcaaatggg

SEQ ID NO: 139646 - DNA, 1065 bp, Homo sapiens
aacattattcccctgcctcagtctgcagctgaagaaatgggctaagagaagttaagtagtttctcttggcatttgaaaacttgaaaatatatcttagaaatattgtttctcagacttagttgtataaaaaggattattatattttaatataaataatttgcaggaaaactaatgagcattttacaggataacagcagcagtcttgaaagtgacaacttctgaagatttagaaaagcttttcagatagcacagtggtaaggattcgagtgatgaaacatcagctaaattaaacttgaggatgtaagtatatatggcattggaaaccatgtggattctagtttagaaattttggctttaaatgggcattatgggaaactcagcattaatcttatttcattcttttgttgccattaaattgtaataagcttattttaaacttcagggtgctttctgagcccttattagcatcataaattttgttcccacatttttaaagtaccttgacagacacacaggttggctgaactgacaggccgccccatgagagttgtgggctggtatcattcccatcctcatataactgtttggccttcacatgttggtaagtatcatggggttgcaatgtttattgttttcagaaattaatatcatgtttccttttccattacatagggtatggttattttaaaccaaaatttgactgtcctttagcagatgtcattattttgatttattttattatgtattaaaagtaatgatttatgtcatattgattgtttttaataagtctgtcagttgatataaaaaaattaaactgttaactgaaaattgctgattgctgaatatcattactgtccaggacactcccattctgcagacttaaagatattaaagggtaaaatttgcaaaattgatttttacagttgctgtttacgtatagtccattggggctctcaatatacatctttacccttctaatcagtgtaatgtaactaaattgctttctttctacctttacccctttttgagaatcatggtgggtttttttgtccgtatctgcgtctc

SEQ ID NO: 139647 - DNA, 2794 bp, Homo sapiens
cttctctattctttttctttccctataggaaagatgaaaatatccagtgtaaagttacttaagctaaatcaatttcaaagaagaaaaacttggaggactcattttacctgacttcaagacttactataaagctatagtaatcaagatagatggtattggcagaggaacagacacatacgtcaatggaacagatgagagaacccagaaataaacccatataaatatgctcagctgattttgaaaaagtgaaaaagcaattcaatggaggaagaatagcctttctgacaaattatgctagagcaattagacacccatggcgaggagaaaaaagaacctctacttaaacctcacatcttatataaaatttaactcaaaatgtataacggacttaaatgtgatacataaaactagataactttgaaaaaagccacaggagaaaaatcttcaggatcttgggctaggtgacaagttcttggactttgccccgaaagcacatccataaaagacaaaatctgatatattggacttcttcaaaatttaaaaacttgtgatttaagaagaggaaaagataagctacagattgagatgaatttgcaaaccatatatctgatcaatttggaatatataaagtgtactaaaaactcaactgaagtcaggcatggtagctcatgcttgtaatctcaccactttgggaggccaagatgggaggagtgcttgaggttaggcgttccagaccagcctgggcaacatagtgagactcttgtctctacaaaaagtttttttaaaaaattaactgggcaccatgacacacaccagtagtcccagctactagggaggcaggaggatcacttgagcccaggagtttgaggctgcggtgagctgtgatcacaccaccacactccaacctgtgtaacagagtgaggcctcatctcaaaaaaaaaaaaaggccacaaaactcaacaataaaaacaaacagtccaattagaaaatgggcaaaagacatgaatagatgtttcactgaagaggatctatagatggcaagtaagcatatgaaaagctgttaaactccataagtcatcagggaatgcaaattgaaaccacagcgaggctatgacttacttatctcaatggctaaagaaaaaatagtgaaaataccaaatactgatgaggatacaaactggatattttatacattgctgacaggaatgtaaaatggtacagccactctgggaaagagtttatgaatttcttatcaagttaaacataattttttaatcaagttaaacataagacccagcagttgtgctcctggacattcattccagagaaatgaaaacctatattgtacttgtactcaaatattcataggagctttatttgtaatagccccaaactggaaacaacccagatgtcctacaacaggtacatggttaaacaaaccatccataacttggaatactgctctggaatgaaaaggaactaactgttgatacaagaacttggttgtacctcaggggtattatggtgaacaaaaaaaaaaccagtctcaaatggtcacatactgtatgatcgcatttatataacattcttgaggtgacaaaattattgaaatgaagaacagattaatggttgccagggatagggactggagggggtgtggggtatgtatgactataaagggatgacgcaaggagttcctttgtgctgatggaacagttctatatgattatgatgattacgatgttgattataacatttgattatgaggttaagcacatgagtctttacctgtgctgaagttgtatggacctacatacacacaaatgaatgcatgtaaaatctggtgatactgaataaagtctgtggtctagatagcagtataatattattgtcaatgtcttggatgtgaagttgtgctatagttacaaaaccgtaccactggaggaaactgggtaatggatacatgggactctgtactatttttgcaacttcctataagtatataattattgcaaaatgaaaagttgtaagttttaagtaaggaactgggacgtatggtacctattttatgaaataagaaaagggtgctagaaaatttgaggggaataaaacgattggaatatttttacatgccaacctttagcacaagtccttttccctttctgggtttcattttctttaggtatagaatgagattagagtagttgaccaccaaggtttcttttagctcagtgtccagtctttaaaagtgttgagcatcacaagaaacagtggtgtgaacaggatgtatcattattttcccagctgcaccaatctggcttacctttacacaaccctgtatccccttatgaacactagattctctattctcaatcacatccaagactctcatggtaactgtatatacttgttctctctgttttcttatctcctataatttcaactcattgccttgtgacctctgtccacagcacttcattgaaactactcctgccaaagtcaccaatgagctccatacagtgaaagtcaatagttgcttttcccatccttgatgaacctctcagtattgacacagttggtcactcctccttgaaatctacttccttggtttctcttattttcttctctggctatccttcctgctatccttttcttctctagctgttccttctcaaattcattcatagacttctctatctttgcatacctatatgcagttgacacacaaatctgtatctgtccacgcctctatctgaactccagacctacatttccacctctctactggacattt

SEQ ID NO: 139648 - DNA, 1080 bp, Homo sapiens
tctgttgcccaggctggggcgcagtggcatgatcatggctcactgaagcctcgacctcctgacctcagcctcccaagtagctgggactacaggcacgcaccaccatgcctggctcatttttttgtattttttttgaagaggcagggttccaccatgttgcccaggctggtggcaaactactgggctcaagcaatccacctgcctcggcctcccaaagtgctaggattacaggcacgagccaccgtgcctggcctccacttggctgtcttaatggcacataaaaattaatatatctaaatctgaaatcatggttttcaatctaaactatattcccttccaacatttcttacctcagtgaatagtgaatgtaacatccatttgcacaaaccagaaaccaaatagacattcttaacatctctctccatcaccttctaaactatttatattgataaagttacagcgatttgaaattctttttctagcctagtaatctgagtaatttgtaggataaacatgttgggggaggggcaggtacatggaggtgtcaaagtgcctgatggctgaggaagcaggctgggattactgcatggaggtgtcagagtttccagctttgtggctccatggttgggtggaggggcagggggagagatccagtggaagccatgttgtgccagtgccctcagggcgaggaggcagccagcagtgtgctacattaagcaaataactaagttgattgagtgaagaagtaaatctgttgaggaaaatgggagctaggtttctcaatgtcagagaaattatttgaaaacatggaaaggccaggcgcagtggctcacgcctgtaatcccagcactttgggaggccgagacgggtcaggagattgagaccatcctggctaacacgctgaaaccccatctctactaaaaatacaaaaaaaaaaaaaaaggttagctgggcatggtggcaggcgcctgtagtcccagctactcgggaggctgacgcaggagaatggtgtgaacccgggaggcagagcttgcagtgagcgaagattgcgccactgcactccagcctggacggcagagc

SEQ ID NO: 139649 - DNA, 1180 bp, Homo sapiens
gtaaaatgaatctcatggtattggattaaaattggaaaagagttcattaatatgaactcttgttcaaaggaaatatatatatatatatatatacacacacacacacacacacacacatatatacacacacacacacatacacacacatatatacacacacacacacatatatacacacacacacagaaaccctatatatatatatctcagagctgagaaaggtatgtgtatatgtacatatctgtctcagctccgtccaccaagagggactagaagtgacacccagtggttatgagcacagctagcaccaagatgctgatttccaaaccctccactaaaaatggaattgaattgacagtccagaaataagcccacacatctacagtcaactgattttcaacaagggtgccaagactatgggagagaatagtcttcaacaactggcgaatggacaagtggatatccacgtgcaaaataatgaagttggactgagatcccacacgataaatgaatattaactccaaacgtattgaagacttaaattcaagagcttaaacaataaaaactttataagaaaacagtagtaaatctttacgatcttggtttttacaatggattcttagatatgacaccaaagtacaagcaacaaataaaaaatagataaattggaatttatggaagttagaaaattttgtgcatccaaagacatgatcaaaaagtgaaaactcaggacaatggcagaaaatatttgcaaatcctatgtataagagtctagtatgcaaaatatataaagaacactgaaaacaacaaaaaccaaacagcacaattcaaaaatgggcaaaggacctaaatagaaattttccaaagaagacctacaaattgcgaagaagcacatgaaaagatgcttgacgttactagtcaccagagaaataaaaatcatgagatatgactttatactaaccagaataaaaatgtaagagaataacaagtgttggtgaggctgtggagaaattggaactcttgtacactacaggtaggaatataaaatggtgtagacaatttggaaaactggctgatggctcctccaaaacttaaacacagaattaccataagacctagcaagggcatttctaggtgtatatcccacagaactgaagacagaaatttaaacaaaaactag

SEQ ID NO: 139650 - DNA, 1046 bp, Homo sapiens
cagaaaggcacagaggctgaaccctcgtgatggcgctaggtcccaggttcgctagcatccgagagaggggattgggtcgctccagaggccattgcgaaggctgctgccagttctagggtcggggtggggtcaggctaggtccctattcctagggctttagcaccgctcactcacaagaccccttttcccaggaggacgtatgggtttttcctgtcgctccagcttctctttcgcggcccttccacgcttgtcacttacctgagcgcagccaatcagcacctagaggttgggctactttcggccaaaggagaacggggacttgtgggggacgctccctgcgcaccaatgaatgtgcatggagatggagaggcgggcctgcaagtgcgaacaagccaatcacggaatcccggcggccggcggcccgggaggcagtcgcgcgctcgcatccccaagatggcggccgttaaggacagttgtggcaaaggagaaatggccacagggaatgggcggcggctccacctggggattcctgaggccgtgtttgtggtaagaggcacgctgttccctggcatcttggcttgaggccttggactgcccctttcttcccggctcccacccaggcctcgactgttggaaggagctgagccaagtgttcagggagggggcgctcggtctgctctcacccctcgcacctggacagattgagctctgctgggggcccgcccggaagaaacgtagctcgagaaggccgtagaagagaacggggtgcggggccgggacgaggggcgaggggcgaggggcggcgggtggcagggcagggcggcctgagggacctccgggctgccgccggttttcgtccccctgctggttggaaaaggggaggtggtgaggagctctcgactcagcatggatgctggagacacagtacaatgaataggcagaacagccagtgctaagatgtgaaaaccgggaatatcactttgtctgttgaaggaatgcagtggtctcgggaatgttgcctcgggaaatggaagaagagaccgatg

SEQ ID NO: 139651 - DNA, 1058 bp, Homo sapiens
cctatttttgaataaaaaatgaagaggaaagtgaaagaataaattagctatataatatatatgtaccatctgaaattgtctctaactttttataactacaggttgagcatcctaaatctgaaaatctgaaatccagaatgctctaaaatccaaaactttttgaacaccaatatagtgctcaaaggaaatgctcattggagcattttggactttggatttttggattgaggatgctcaactggtataatgtaaatattccaaaatctaaaaaaaaaaaaaaaatctaaaatccaaaacaattctggtcccaagcattttagataagggtgcttaacctgtacttttagttaaaaacaaacctttggagaaaaacaaagcttttttttcttctatgttttaaaaacaaagcagtcaaaaaatctgagtggcatgaattctaaaatttgtaaagtattatttttgatattaaaggaagatgtagattccttcatgaaacagcctgggaatgagactgcagatacagtattaaagaagctggatgaacagtaccagaagtataagtttatggaactcaaccttgctcaaaagaaaagaaggtaagtgtaaaaatttctaagttttgaaaatcttatatgacttgaacttttaaaaaattgagatataatttacatataataaaatattcagatgtcaagtgttcagtcctccaaggtggctgtaccatatgaaattcccaccagcaacgtacaagagttccagttgttccgtatccttgccaacacttggtattgccagtctaaatgtggttttgaaaacataatagaatggttgttaaagactgtattccaaagctttcaaaatcataacgtcttatatgtctagttcatccttctaattttgccagtgagattagagacccacagagtctgggcataagacttaattagttatgaaatcccaagatttcataactaataggcataggaaaaaagctatccttactctcaactctttatttccctacattattttatatagcttataaagtcaattcactg

SEQ ID NO: 139652 - DNA, 2582 bp, Homo sapiens
ttggaaattctaaaatacatgcagaagaaaaaagtaagtgcatttttgtttgtaaatatgagcaagctaggatatgtcagcagaaactcgtcttctttgactctttggtcactgatatttgatctgtgctgtggaatccagtctgccttcttaagcacatacactaatgttatgatgtgcttctgtagcaaatgtggctttgtggccttcccccaaaagtcaagtttaattctagggcccacacttggattactttgcttatctttagtgcttgtgaaacttaaatgcaatttgaaattgttttaggtgtacaaagaaaatgtcttattctgtgctagcagcatctagggttttttctttgttgttgtctttctccctaagaataaggagttagtccaagatttatagagctggaacgaatcttagagatcatctgttacaggttctcatttcatagttgaggaaatggttatggagaggttatactcgaccattgtctatgtagttagttactggcagaactaaatttgagagtcttctaagtcttaatccagtattcattaaataaaagcaggttgtaaagattaaatctcataagcatattgtatttaaaagattgtgtgtatgcttatgattttgcttgactggtagaataactatttctagtacattttaatatgtggtgaactttgtaagacttcagcaactgattgattgggcatgaagcaccaatgaaataatagaagaatggctaattcttacaataatgccttctctgtatgtcaggcactcgggggtgtgtgtgtgtctgtgtatactcagtgcttaccactgacttcataggtgtagggactgttgtaatcctcattttacagatgaagaacctgagatatagaagttaagtgagatgccagatttgtacagctagtgagtagctgagccagagtccatacccagccacctgggtctagcattcatttcttttaccactacacttagcctgcatgatggtactgttttaaatgtcctaggttcaactgtgcaatctctcctttataaccttggtatcaaactggcctgtttatggtactgtcattttttttttttgttttgaaggagtccaccaactcaatggagaccagattcttgctggcagataacctgtattgcaaagcttcagttcctcctaccgataaaatgtgtctgtggttgggggtaagtaaatgttatagccacagctgatatatttgtaaaccagtgtgttttctgtagcaaacacactggttttgctagtatttgctagtattttagtagtattgctcgagatatgtaaagtgttcatctccttttgattgtggaagggacaaagggacagagtccaagtggttcatattagaaattgactagaatcagaagtgcgatgaagatcgcagtaaaaacatactgaagtctctcccaatcaagataaaactgatcaaacaaaccctgcttctcttccagttagtgctttatctctcttaaatataatggaggaagagcaatagaagtaaaatagaaggtactgctgaactttagataaacgcttcttcccataagagtttaataattctagaaagatccctctcaatttaaggggaaaaagagtattgcaaaaagtttgaggttagagtttattttttaaaaccatgtatttcagttttagatgatttcattgagcttatctgtgatttacctattttgctcttctcagtcctctgactatccagctacctgtctgtggatcttgttacctcaggcaagttctcatacaaagtagcaagccaagtgtacttctaccagctgtcctacggggaggatttcccctagctgctgtcctgtaggatcactctggagaggcactctagattagcccaaggaggtttgctcaaagtttgtacaacatttatatttcactctacaatctgcatttcagtatttatcttttataatttatcactaaggctttttaaaaaataactttgaagcatagcaactacacctgagtgtccaaggattcaatgattttctgtattcagtttttttgtagaaattgcatgaccttttgattcacaaattcaagtgttactttatttcaggaaagataatttctgttgtgtacttgaatgtgacttttgccccatttcttttattatcttttgggaataataaatatgcatatgttcgatctcctttatctgttttcagtacctatcatgttctctgttttcagttattcgatgtgtttcattctgtgtgatttcctctggctgcttccccatgactttgtgttttccctggtagttattctgttttgttgcttttactctgtctttcgtaactgttcttctgtttctctttctcttcattttctttgctgagctcttcttgctcttttcatgtttttcttctttcattcctcttgaatgtttaaatcctcatttcaccactcatagactggcacttcccacaatcttctccatctcagtaaatggcagaatcttttgcctggttgctcagaacaaaaatctttgagtcttctttga

SEQ ID NO: 139653 - DNA, 1721 bp, Homo sapiens
agggtacatgcatccctgaatgttggcagtaacactagatcttcagaatgacagacacattaccttgtcttaatccctaacatctgtcagaagtagtaggaagggacaggtaaaagctagctgtcttttttacctggtcaaatatagatgataataaatgtctttgaaaaattttaaattaatatcatatctcaagctcagaatttatttaaattgatacaaacaacactatttagtttcacgatggaggtagtagaaagataggattttgtatctaaacatactggtttcttatcctgattctcccatttacccactagctatgccagctaaggaaacctgagccttcatttctttaactgtgaagaagacaactttggcctcagcagggttgaggattaaatgatacaatgtatgtaaatatattctttaaccaaggggtcagcaaactttctgtaaaaggtcaaatggtaaatatttttggttttgtagatcacatggtctctgtctcaaccactcagttttgccattgtggtatgaaagcctgagtagagaatagctgggctccagtgaaacttaacttacaacaaaaggcagcaagctggatttgacctgagggctgtagtttgcccacactttactctaacctataaagctctgtgtaaatattgagtaattgtcatgactttctctcttcaggctaatgtaatgcttgaatatgatattgatgaagctcaggcattgttggaaaagaatttatcgactgccacaaagaatcttgattccctggaggaagaccttgactttcttcgagatcaatttactaccacagaagtcagtatcctttcttaaaacaaaaagcaagggaaaaaaggagaaagatttttttaaaaaaacattctttcatgggcagagggagagcattaggaaaaatagctgatgcatgctgggcttaatacctaggtgatgggttgataggtgcagcaaaccaccatggcacacgtttacctttgtaacaaacctgcacatcctgcacatgtaccctagaactaaaaaaaaattagaatacaaaaaacctcccacattctttcttacattgctttagtgggaagaatttccttattaggctaatataaaggttatagattttataagataataaataagatattcggaactagtacttaaataagtttgtagatagattagtgattttgaaatgtgatgtggaaacagcaaattcacataggtgagtaagtatttttcttccaaatattttcccaagacaactttataactggttaaatagtttaatttcacaagcatttaagggtctcctatgttcctgcaactgtgctaagacatatggggcatgaaaatcaattttagaaaagagtggcagtgcctttctctggtagaactgtacatgtaaaacagctgaatgataattcatagcaaactataagtaagttaacatatgcaacaccaaggcaatttaaactttgggaaagatagatgtaggctggacttagttcaaagaaggctttgttgagaagataaaagttaggctgcttttttaaaggcggcgtagggtttaaagatcagcagagagaagaggtgggagtggggtattctggtcaagggggaaggcaagctctttgcctttcttctctggcctgtcttttcctcctacttcctgtcacagtcactcaagacaaaat

SEQ ID NO: 139654 - DNA, 1033 bp, Homo sapiens
gttaagcagtaagtcatgaaactccacttatagaagacaatagcaacagaggaccactaagtcctaaatataccaaagaaaaacaagtttacaaatattcaaactgtctgtcttctctacctctaaaatggtttaaccacatcaagtgagagtaacatcagccgattagaaagggaaaaagtaaactgtgctagcgtccggcattcagcttccatagcatgtctcacagttttcggccatttcagctaagagttttcttatgacaggcaaaaataatgattaaaataccattagctttgctgagaaatgtggaaaaaaaaatcacaatgtcaaaaatatttgaaactaattttgtttttataaataaataaaatggtgtttatcttttcttaaaattcttgctgttaaaacattcaaagttatgtcaacctgtaaggataaaggggtatttaagataacatgtttggaaaactaaaccacatttttaattgccagcattatgctttgttcttggtagagtcatccttgtttcttctttttacatcccaattataaaccctggccatatctgcaagaattgtcaaagaaaatgcaaatgcaattctaaagataatgcatgcaatgactaagtattcactccactcacacaatgaatcaaagacacagaaatgaaacatatacaaatactggtaacaaatagtattgtaagacatcctgctataatgtcaattgttaggaaaatactataattaaactctatcaaaactaaggactcaaattaattgttaacccattgtttactatggtattagtcaactgtcagctagtcaactatgatatatttaacaaatatgtactagacactctcgatagttttaaagacagtccctcatccaagaaatctgaaagatcactcaacccatatcctgccatgtaatatttatattattacaattatcaataattttatctcttaccctccctttggcttaacaagtttattaagcatctactgtatttttgactaggcact

SEQ ID NO: 139655 - DNA, 1738 bp, Homo sapiens
atagagtttaattatagtattttcctaacaattgacattatagcaggatgtcttacaatactatttgttaccagtatttgtatatgtttcatttctgtgtctttgattcattgtgtgagtggagtgaatacttagtcattgcatgcattatctttagaattgcatttgcattttctttgacaattcttgcagatatggccagggtttataattgggatgtaaaaagaagaaacaaggatgactctaccaagaacaaagcataatgctggcaattaaaaatgtggtttagttttccaaacatgttatcttaaatacccctttatccttacaggttgacataactttgaatgttttaacagcaagaattttaagaaaagataaacaccattttatttatttataaaaacaaaattagtttcaaatatttttgacattgtgatttttttttccacatttctcagcaaagctaatggtattttaatcattatttttgcctgtcataagaaaactcttagctgaaatggccgaaaactgtgagacatgctatggaagctgaatgccggacgctagcacagtttactttttccctttctaatcggctgatgttactctcacttgatgtggttaaaccattttagaggtagagaagacagacagtttgaatatttgtaaacttgtttttctttggtatatttaggacttagtggtcctctgttgctattgtcttctataagtggagtttcatgacttactgcttaacgaataactaactactatgatattctggacattttaggaaatggtaatttgccttgctacacattaagagggctattaagactacattttttctaacctcagataagtgcagtgtctttgcaatgccaacataagggagatcttggccaacgtgaaataaaattactcattcaaaactctgcctaaggtgattttgtagttcttaacagttctccagagcatcttgaacaggaatattaagataaatgtgaatctgcaatggctgaaaagagttgtgagcttttttattcatgataaaaccttataggaatagtataaaaaatccctgtggaaagctactagtacattgaccagcgctgggtgatacagattctgataaaaacataaatgtattagttcatctccatgtagtaaaaagtatacttatacaatgttttgtacttgtatttcatgaaattaaaacagtgatgctaaaactatggcagagcacttttttcatgttactctttgtcttactatgtttgggctgctataacagaataccacagagtggggggcttataaacagcagaaatttatctctcccagttctggaggctgggaagtccaagatcaaggtgctggcagatttggtgtctggtaagggctgtgtcctggttcgtaaacggcaccttttcactgtgccctcatgtggcagaaggggcaaggagctcccttgggcctctttaatttggcactaatctcatcatgagggctctgcccttatgacctactcacctcccaaaagccccacctcctaataccatcaccttgggggttaagattttaacataacaattttggggtgacacaaagattcagacaataacacctttttaaagttaacatgggtcttttcacgtatttgtaaagtttacttgtacatatactagcatgttccaagaacaacttatatttctagaaacaccataaaatccct

SEQ ID NO: 139656 - DNA, 1001 bp, Homo sapiens
gtaaattttaagggtcagatggaaacatttctgtctgggttaggtgaaagacaatcagccaggaggtccaagtagttaatctccaaagttccttaataaatggatctgaaaacgtttttctcaactcaaaaccaagtgatgttataaatttagtgaacctatgaagtcattgcagagtgcaagcttttaaggcttgtagcccaaactaggcaataactaaaagtttcattttcacactttttattttgaaattttgtaactatgaccagtgtcatcgttaggcctgctaattaaccatatttcctatatattcatactcttttctgtactcagggagaactgcttgtatgaccagttgtgagaaggtaccagtttgagattggaagtgtccaaggctggagaaattgattcacgtattatgtgcacagagttgcttttcttgtttggttaggagaagatggcccaggatctcatctgcacatgaaaattcatatggattatgccctaaagttcaactagagaatatacttgtgtttgtgttcctctcttgtctgatgtcagatttagctgtagtcacgtcaaaaaggatagacctggtgtgcacagtatttttgagcagtttataaaggatcatgcctcttgattatggttttcaaataattttatgtgttagttgattgtgtgacaactctatttgccttctgtggatatttgatatacaggtaggcaatgaccaaataggattttttttccagattttccaagtacacccatcttagactgaatcagtttattttccctagatcaaagctgtggattctagagtaaaagtaaaaaatttaaaggtaaaaggtcagtggataacaatctcttgcatttgtctatttttgcttgtattacctgtgcttttagagtcatatcccaaaaaatcattgcccaggtgaatgttatcaagctttttccctatgttttcttccagtagtttttacaggttcagaccc

SEQ ID NO: 139657 - DNA, 1019 bp, Homo sapiens
aactacaagtgaactgatcatcttctctatattcatttcacaagagctggcttaggtggggtaattaaattgccaccttcgtggttgtaaaagacaaacaaaacatggcaaatttcattaacacaaaatttcatcaactgctatactgaattatgtttagaagattctgaaagcaagattatccagtgggtaaatgagagtcgactggattctgtcagttcaaaaaaggaaagaaacaaaacttccctacaattttcttcactaaaatttattatatgtacagtattcccactcctggcattttctggcaggtttaaaaatattcagcataaatccagcagaggtggctgagcttaattgcttaaataagttctagaaaatttaaaaatcattttagtagaattcagtaccattgtcactgcaataagtgggttttagaaaataagtgtgaaaagaatcaggtgttaatataatactaaggataaagctttagaagctattttactacataggtaaagaaaagataaactaacttgtaacaaagaccacaactgcatgttggattagattgtctcatatttcagaataaaatgtactgtatacttttcctcactttgttgtgcactgtaatgaaatgtgaaaaatgctttatttagctgtatgtgaatgaaaatatgcttgtatttagtaaaatgattgattatgtgactgtgagattccaagtgtgtgttatagctatttccagaatctgttactacagcgtagcaactactaccaaggatatcaataagatgtgacatataccatacacaatcgtattcaccattaccttaaagccagaaagagaatataatttttgaaagttatctgaccatcatatcaaaagtccctgggacctcaatacttcctggtgagcatatgccactttgagaaaagttggttctgtcaagcctaaatcttcatcatgatgatttttaatcaagagtcttaattctgttgccaagtagttgattacaact

SEQ ID NO: 139658 - DNA, 1028 bp, Homo sapiens
gaaaggaaggcaatcgacacagttattagcacatttcagaaaatgaacacccttgtgatagaattaccagctgtatgaaacaaattgtcccatgcaaattaccctataactaggaaagagacactataacccaaatgccataccccctttttcctttgaccatgcctggggtttcaatgccttggcacctgcaatctggaagtaaacagtctgcttgcttcttcaggcacgtgacagtgacaacacagtgactgcctctgaaaagagccctgaggcaaacactctctcctgctgaacaggaggcactgtaacccttacaaacagcttacagttacttgggctacttatttgatcatcataacaggcctacgaggtttttgccccattttacagaatagtaaactaagagccatgaaaatcacttggccagggtcaaggactcgtgactcctagctcttttcactgcatcatactgctgtcagatgaataaatgattatgaatttgtttacttgggaagagatatgactataaataaatgttctctacatgttaggatatgttttccttattgattacaactcagctataatcctgagggaacatgggaaggaatcaaaggtaaagcccattcaggcattattgacaagagggctttaaacaagtgaataattgcacaactaaaaagacattagaactgtgtgggctataagtgttcttatcactgagacacagtggatttttattgaaaggaaccacgtacagcaatgcggagtgggatagggataaaatacccaccccaaaatgaccttggccacctgtctgccatatacgtacactgagttcctgtctacccaagagagtcagcccttaattctcaggtgaacaaacagctaactgcatcagcaaattggaatggctggcttgaagtttccattattttcttgaagagaggtgatgctttaaattactttttggattgtagccagttcagctaggcaaaagccatacttttcacaattaaaaaaaa

SEQ ID NO: 139659 - DNA, 1046 bp, Homo sapiens
gccgcccagctccagctgccccagctgcccctggccgcgctgcaggcgcttggcgaggccgcctcctgccagctgctggcgcgcgactacaccggcgccctggcggtcttcacgcgcatgcagcgcctggcgcgggagcacggcagccacccggtgcagtcactgccgccgcccccgccgccggcaccccagcccgggcccggggcgacgcccgccctaccggccgcgctgcttcctccgaactccggctcggcggcgccctctcccgccgccctgggcgccttctcggacgtgctggtccgctgcgaggtgtcccgcgtgctgctgctgctcctcctgcaaccaccgcccgccaagctgctgccggagcacgcccagaccctggagaagtactcctgggaggcttttgacagccacgggcaggagagcagcggccagcttcccgaggagctctttctgctgctccagtctttggtcatggctacccacgaaaaggacacggaagccatcaagtcgctgcaggtggagatgtggccactgttgactgctgagcagaaccacctccttcacctcgttctgcaagaaaccatctccccctcaggacagggagtctgatccatcccattcacccagtgacttctttttgcccaggccgggactttttgcatcagtcacgttaaccagatgactttgcctgttaccaaacctcatgcatccacgtttgcgtctggggaggaataaaaagacatcgttcccgcttctgcgttttgttattcctactgccgccataggaattatttcgttggctgaacgttaccagcaccccgagaacacattttgatagaatcagagtagaggacatggctgtcttctaaaaagccacgacatgaaaatgacaatccctttcgtctccttcctccgctgcttccacccaacgcagcctcctgcctccgcctttgtttcatagtgaggattttattttgcacggcgccctccctctaaatacctaccctagatgatttcatcctgcccctcacttcttaaca

SEQ ID NO: 139660 - DNA, 1115 bp, Homo sapiens
tataattatactgatcaagtatacaaatggtaagtatttagacatttttagagcatttcacattgctgctttatccaagtgcatcatttcgtattttacaaaagtccatggccgattggaaattaaaaaaaaaaagttccttcaccacaaagagttgagaagcactgctctagagtgtctcaataacgtttttggtcaggtggcatagtttcccttcttgtattacctttgtcttcctcagagttggcctttaagccaaggacctggctgccttccaggcagtcatttcctcatagtttaatagctatagccagtgaactgaaagtgcatttcctgccaccatactgtaaaattattattaatgtaataggagaatgcacttctggttttggcactgatatttgggatactgcatagggctggtagcttaaaagagtgggcaatattttggagtatggattaatggagatagaaccactaggaatacttcctgttaaaatatgctatatttgccatttagagataatttaataatatgatattttaaatgaaaataggaaaatcttttcttttgtggggccatgaagctttgctcaaaggaagttttaaggaggtgggtcttagctcattttaagagctaagtactaatggaatagtttctaactactgatggaatagttttatcaggtaaatgctcaaagactgatttacaaactatcattggttctctaataatgaatcctgcaattagttgaaaattagattaagctctagggccccttccaaagcagaattctataattatgtgctgaagtagatttaggcatcaaaggaaggaaaattaattttgaatcagcagtcattaagtgtgacgtcctgtgattctcctttaatttagagaaaaattctgcgatacttcaggaaggatgtaatactgaggtcatttgagggctgaaagtttacttggagtcgcatgtggtcccagatccacagtttggagccaagaggagacaataaaagatttaaagaaagagtaaatggaaatacagacagaaatagaaacatatagtacctggaaaccttatgtgtggagtgaacactctcagtagccttct

SEQ ID NO: 139661 - DNA, 20 bp, Artificial Sequence
  Description of Artificial Sequence: Synthetic primer
cggttcttccgtggtttctc

SEQ ID NO: 139662 - DNA, 20 bp, Artificial Sequence
  Description of Artificial Sequence: Synthetic primer
ggtaagtccaccatacacac

SEQ ID NO: 139663 - DNA, 21 bp, Artificial Sequence
  Description of Artificial Sequence: Synthetic primer
ctcgacagcccaatctttgtt

SEQ ID NO: 139664 - DNA, 20 bp, Artificial Sequence
  Description of Artificial Sequence: Synthetic primer
accaacacttccacttagcc

SEQ ID NO: 139665 - DNA, 26 bp, Artificial Sequence
  Description of Artificial Sequence: Synthetic primer
actttgcatacagtcctactttactt

SEQ ID NO: 139666 - DNA, 25 bp, Artificial Sequence
  Description of Artificial Sequence: Synthetic primer
ggaaaggagacttgagagatgatac

SEQ ID NO: 139667 - DNA, 20 bp, Artificial Sequence
  Description of Artificial Sequence: Synthetic primer
aatgcttgccagctatgcgg

SEQ ID NO: 139668 - DNA, 20 bp, Artificial Sequence
  Description of Artificial Sequence: Synthetic primer
taaccacctgtaagggacag

SEQ ID NO: 139669 - DNA, 20 bp, Artificial Sequence
  Description of Artificial Sequence: Synthetic primer
ttagccaggcagctagagga

SEQ ID NO: 139670 - DNA, 20 bp, Artificial Sequence
  Description of Artificial Sequence: Synthetic primer
agccgtattcctccatggtt

SEQ ID NO: 139671 - DNA, 17 bp, Artificial Sequence
  Description of Artificial Sequence: Synthetic primer
cgatgacgagcccttgg

SEQ ID NO: 139672 - DNA, 23 bp, Artificial Sequence
  Description of Artificial Sequence: Synthetic primer
tctgctgtctttggaactttgtc

SEQ ID NO: 139673 - DNA, 25 bp, Artificial Sequence
  Description of Artificial Sequence: Synthetic primer
tgtaaacctctttggcaatgctgcc

SEQ ID NO: 139674 - DNA, 25 bp, Artificial Sequence
  Description of Artificial Sequence: Synthetic primer
tattgatggacccaggacctctggt

SEQ ID NO: 139675 - DNA, 19 bp, Artificial Sequence
  Description of Artificial Sequence: Synthetic primer
cgaggacttcacgcacaac

SEQ ID NO: 139676 - DNA, 20 bp, Artificial Sequence
  Description of Artificial Sequence: Synthetic primer
ttacagttggagggtcctgg

SEQ ID NO: 139677 - DNA, 18 bp, Artificial Sequence
  Description of Artificial Sequence: Synthetic primer
caccctgaacatccaaca

SEQ ID NO: 139678 - DNA, 20 bp, Artificial Sequence
  Description of Artificial Sequence: Synthetic primer
catctgcttttcctacctgg

SEQ ID NO: 139679 - DNA, 20 bp, Artificial Sequence
  Description of Artificial Sequence: Synthetic primer
taagcgcttgcctctgtctt

SEQ ID NO: 139680 - DNA, 20 bp, Artificial Sequence
  Description of Artificial Sequence: Synthetic primer
cacctgcattctgtgtggtc

SEQ ID NO: 139681 - DNA, 20 bp, Artificial Sequence
  Description of Artificial Sequence: Synthetic primer
tgagtgctttgccactgaat

SEQ ID NO: 139682 - DNA, 20 bp, Artificial Sequence
  Description of Artificial Sequence: Synthetic primer
taacagcttcccctctgctc

SEQ ID NO: 139683 - DNA, 20 bp, Artificial Sequence
  Description of Artificial Sequence: Synthetic primer
tagtgtcccgaggacaaacc

SEQ ID NO: 139684 - DNA, 20 bp, Artificial Sequence
  Description of Artificial Sequence: Synthetic primer
agtgagatccagggatgcag

SEQ ID NO: 139685 - DNA, 20 bp, Artificial Sequence
  Description of Artificial Sequence: Synthetic primer
actcggaattcaggtgtggg

SEQ ID NO: 139686 - DNA, 21 bp, Artificial Sequence
  Description of Artificial Sequence: Synthetic primer
ggttggaggtcaccacaacat

SEQ ID NO: 139687 - DNA, 18 bp, Artificial Sequence
  Description of Artificial Sequence: Synthetic primer
agatgagtccaggtgctt

SEQ ID NO: 139688 - DNA, 19 bp, Artificial Sequence
  Description of Artificial Sequence: Synthetic primer
caagtccagagtagccaac

SEQ ID NO: 139689 - DNA, 23 bp, Artificial Sequence
  Description of Artificial Sequence: Synthetic primer
atgaatacggctacagcaacagg

SEQ ID NO: 139690 - DNA, 22 bp, Artificial Sequence
  Description of Artificial Sequence: Synthetic primer
ctcttgctcagtgtccttgctg

SEQ ID NO: 139691 - DNA, 18 bp, Artificial Sequence
  Description of Artificial Sequence: Synthetic primer
gtccacactccgccagca

SEQ ID NO: 139692 - DNA, 29 bp, Artificial Sequence
  Description of Artificial Sequence: Synthetic primer
ttaggacagagtgaaaatccggaagttgt

SEQ ID NO: 139693 - DNA, 36 bp, Artificial Sequence
  Description of Artificial Sequence: Synthetic primer
cctattacaactattactccatgctacaacttctgg

SEQ ID NO: 139694 - DNA, 30 bp, Artificial Sequence
  Description of Artificial Sequence: Synthetic primer
ggcatctgattctctctttcattgtccatg

SEQ ID NO: 139695 - DNA, 21 bp, Artificial Sequence
  Description of Artificial Sequence: Synthetic primer
ctcaagagccttaggtcccgc

SEQ ID NO: 139696 - DNA, 23 bp, Artificial Sequence
  Description of Artificial Sequence: Synthetic primer
aagtgtgtagcgcttgcaggtac

SEQ ID NO: 139697 - DNA, 22 bp, Artificial Sequence
  Description of Artificial Sequence: Synthetic primer
tgagatgcgggctaaggagagg

SEQ ID NO: 139698 - DNA, 24 bp, Artificial Sequence
  Description of Artificial Sequence: Synthetic primer
ctgaaagcactttgccactgtccc

SEQ ID NO: 139699 - DNA, 21 bp, Artificial Sequence
  Description of Artificial Sequence: Synthetic primer
acagtggagcgatggctacgt

SEQ ID NO: 139700 - DNA, 23 bp, Artificial Sequence
  Description of Artificial Sequence: Synthetic primer
cttcatctccgcatagctggcaa

SEQ ID NO: 139701 - DNA, 28 bp, Artificial Sequence
  Description of Artificial Sequence: Synthetic primer
tctgggaacttctacctgatcctcacat

SEQ ID NO: 139702 - DNA, 29 bp, Artificial Sequence
  Description of Artificial Sequence: Synthetic primer
aactagaaacaggcagttaaggtccaagg

SEQ ID NO: 139703 - DNA, 30 bp, Artificial Sequence
  Description of Artificial Sequence: Synthetic primer
cttctacttggacaaaccatgtatcgctcc

SEQ ID NO: 139704 - DNA, 23 bp, Artificial Sequence
  Description of Artificial Sequence: Synthetic primer
tcccaaggtatggagtcaccagg

SEQ ID NO: 139705 - DNA, 28 bp, Artificial Sequence
  Description of Artificial Sequence: Synthetic primer
aggcttctgtaacttataaaatggcggc

SEQ ID NO: 139706 - DNA, 26 bp, Artificial Sequence
  Description of Artificial Sequence: Synthetic primer
cagggcatgttcattaattggccagt

SEQ ID NO: 139707 - DNA, 30 bp, Artificial Sequence
  Description of Artificial Sequence: Synthetic primer
cattaatccaccactgaaggaagtcagagc

SEQ ID NO: 139708 - DNA, 22 bp, Artificial Sequence
  Description of Artificial Sequence: Synthetic primer
aggtgagccagcaagccgtatt

SEQ ID NO: 139709 - DNA, 21 bp, Artificial Sequence
  Description of Artificial Sequence: Synthetic primer
ccagggcgaggcttatccatt

SEQ ID NO: 139710 - DNA, 22 bp, Artificial Sequence
  Description of Artificial Sequence: Synthetic primer
gcagtcccccactaccacaaat

SEQ ID NO: 139711 - DNA, 38 bp, Artificial Sequence
  Description of Artificial Sequence: Synthetic primer
taatacgactcactatagtgagtgctttgccactgaat

SEQ ID NO: 139712 - DNA, 36 bp, Artificial Sequence
  Description of Artificial Sequence: Synthetic primer
taatacgactcactatagagatgagtccaggtgctt

SEQ ID NO: 139713 - DNA, 41 bp, Artificial Sequence
  Description of Artificial Sequence: Synthetic primer
taatacgactcactatagatgaatacggctacagcaacagg

SEQ ID NO: 139714 - DNA, 38 bp, Artificial Sequence
  Description of Artificial Sequence: Synthetic primer
taatacgactcactatagggtgctggtggatcgttaat

SEQ ID NO: 139715 - DNA, 24 bp, Artificial Sequence
  Description of Artificial Sequence: Synthetic primer
ctccactccctattgctttctatc

SEQ ID NO: 139716 - DNA, 40 bp, Artificial Sequence
  Description of Artificial Sequence: Synthetic primer
taatacgactcactataggaagtgtgtgagcagagtaagg

SEQ ID NO: 139717 - DNA, 20 bp, Artificial Sequence
  Description of Artificial Sequence: Synthetic primer
gatgcgtgaagacccatgaa

SEQ ID NO: 139718 - DNA, 39 bp, Artificial Sequence
  Description of Artificial Sequence: Synthetic primer
taatacgactcactatagacaaggtccatgctctgttcc

SEQ ID NO: 139719 - DNA, 38 bp, Artificial Sequence
  Description of Artificial Sequence: Synthetic primer
taatacgactcactataggcaagcgctacacacttgcg

SEQ ID NO: 139720 - DNA, 20 bp, Artificial Sequence
  Description of Artificial Sequence: Synthetic primer
ttgcaggtacttttgggacc

SEQ ID NO: 139721 - DNA, 20 bp, Artificial Sequence
  Description of Artificial Sequence: Synthetic primer
aagatgcgtggatatctcgg

SEQ ID NO: 139722 - DNA, 20 bp, Artificial Sequence
  Description of Artificial Sequence: Synthetic primer
ttagcccgcatctcacccac

SEQ ID NO: 139723 - DNA, 37 bp, Artificial Sequence
  Description of Artificial Sequence: Synthetic primer
taatacgactcactatagacggcaccaccaggcttct

SEQ ID NO: 139724 - DNA, 23 bp, Artificial Sequence
  Description of Artificial Sequence: Synthetic primer
gagtttatttgggcttacagttc

SEQ ID NO: 139725 - DNA, 21 bp, Artificial Sequence
  Description of Artificial Sequence: Synthetic oligonucleotide
gaaataacctccagagaaatg

SEQ ID NO: 139726 - DNA, 21 bp, Artificial Sequence
  Description of Artificial Sequence: Synthetic oligonucleotide
ctttattggaggtctctttac

SEQ ID NO: 139727 - DNA, 21 bp, Artificial Sequence
  Description of Artificial Sequence: Synthetic oligonucleotide
cctaaggttaagtcgccctcg

SEQ ID NO: 139728 - DNA, 21 bp, Artificial Sequence
  Description of Artificial Sequence: Synthetic oligonucleotide
cgagggcgacttaaccttagg

SEQ ID NO: 139729 - DNA, 23 bp, Artificial Sequence
  Description of Artificial Sequence: Synthetic primer
gtacgttactcgctagcagtaat

SEQ ID NO: 139730 - DNA, 22 bp, Artificial Sequence
  Description of Artificial Sequence: Synthetic primer
atcctttgattttctaataccc

SEQ ID NO: 139731 - DNA, 20 bp, Artificial Sequence
  Description of Artificial Sequence: Synthetic primer
ttctttgcagctccttcgtt

SEQ ID NO: 139732 - DNA, 19 bp, Artificial Sequence
  Description of Artificial Sequence: Synthetic primer
atggaggggaatacagccc

SEQ ID NO: 139733 - DNA, 16 bp, Artificial Sequence
  Description of Artificial Sequence: Synthetic oligonucleotide
actacgcaggcatttt

SEQ ID NO: 139734 - DNA, 18 bp, Artificial Sequence
  Description of Artificial Sequence: Synthetic oligonucleotide
gtatggagtcaccaggtt

SEQ ID NO: 139735 - DNA, 22 bp, Artificial Sequence
  Description of Artificial Sequence: Synthetic oligonucleotide
gtgtaacacgtctatacgccca

SEQ ID NO: 139736 - DNA, 20 bp, Artificial Sequence
  Description of Artificial Sequence: Synthetic primer
gtgtgtcatagctcaagagg

SEQ ID NO: 139737 - DNA, 20 bp, Artificial Sequence
  Description of Artificial Sequence: Synthetic primer
ggagcctaaacctgtctgtc

SEQ ID NO: 139738 - DNA, 20 bp, Artificial Sequence
  Description of Artificial Sequence: Synthetic primer
aatgcttgccagctatgcgg

SEQ ID NO: 139739 - DNA, 20 bp, Artificial Sequence
  Description of Artificial Sequence: Synthetic primer
taaccacctgtaagggacag

SEQ ID NO: 139740 - DNA, 26 bp, Artificial Sequence
  Description of Artificial Sequence: Synthetic primer
caaggttgggaacaaggtatatcagg

SEQ ID NO: 139741 - DNA, 28 bp, Artificial Sequence
  Description of Artificial Sequence: Synthetic primer
ggacaagggacagaagtgcttattttac

SEQ ID NO: 139742 - DNA, 23 bp, Artificial Sequence
  Description of Artificial Sequence: Synthetic primer
atggctttaagtctgtagcacaa

SEQ ID NO: 139743 - DNA, 23 bp, Artificial Sequence
  Description of Artificial Sequence: Synthetic primer
cagcctctattcagctagactcc

SEQ ID NO: 139744 - DNA, 20 bp, Artificial Sequence
  Description of Artificial Sequence: Synthetic primer
acattccggctacacacaag

SEQ ID NO: 139745 - DNA, 21 bp, Artificial Sequence
  Description of Artificial Sequence: Synthetic primer
tgggtgttatacccgtgtagg

SEQ ID NO: 139746 - DNA, 27 bp, Artificial Sequence
  Description of Artificial Sequence: Synthetic primer
aacccttttaagtccactgtaaattcc

SEQ ID NO: 139747 - DNA, 24 bp, Artificial Sequence
  Description of Artificial Sequence: Synthetic primer
tagagagccagacaatgctaagcc

SEQ ID NO: 139748 - DNA, 20 bp, Artificial Sequence
  Description of Artificial Sequence: Synthetic primer
gtcactcaggcatagcattc

SEQ ID NO: 139749 - DNA, 20 bp, Artificial Sequence
  Description of Artificial Sequence: Synthetic primer
gtctgccgagcaatatgtag

SEQ ID NO: 139750 - DNA, 20 bp, Artificial Sequence
  Description of Artificial Sequence: Synthetic primer
gagctctaagggaggctccg

SEQ ID NO: 139751 - DNA, 20 bp, Artificial Sequence
  Description of Artificial Sequence: Synthetic primer
catcatggtgtcctcacagg
